United States Patent 7,368,527 (HADDE71 POLYPEPTIDES) - sequence listing, part 10

SEQ ID NO: 14779 - DNA, 65854 bp, Homo sapiens
gggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggtgaggtttagcgggccgggggtgtggtttgcgttcaacagagggaaaacgtagaccaggaatagggcctgcaaccgacctctgaggtctgggacatttttccattgattggcaaccagcgggctaaacccacgtatgatcatatttcccccacctcccctatccagcagtttcgttttcttttggtagggggtgaataaaattaaatactagggtacctttttccttagtcttattctatcgaaagtggacctttgggaaggcccatggtcgtggttgaaaatagcatagttatatcgtttggcaagtggaagaggattggaaattctcctggtttatagcggaaagtggtaatgcgttcattgttggaaatcacttttccagaatcaggctcagcttcctactactattatggtatttttaccgataaggaaacaggcttctagagtaaccgtaatagcagagagattagaaacagtccaggtttctggctgcaataacctgggtaatagttttatgttttagactaactggctttcctttttatgtatctggatttcttttctaggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaagtaagtactggtctggggatcccagggcagcaactcccttaaccttgcaggacccatcctgggtcatccccagaagagccttgagttcaggtgtggatactttgataaatgggtttcaagagagtgaaggattcatttggacaacttcgtaagccccaggcagtccattcaccgaacacaaatttgctgtgggctggttactaaggagacaaaaatgtagtgcaaaaaagtactggcagaatcagtttgatctctgatttacagccctgataaaataggacactgctctctaatgtttagtatgggtgaaaatgaaaaatatgtaacttctatgtaacaggatggggttacactgtagtaagggctgccatcagaggtggggagtttgtgacctaagtcagctcccccatcatctcctaaactgttaaagtgtttacacttttctgcattatagtcatccataatctcattacacagataaacatttggcatcttccaggtttttaaattgagcctgggcgcggtggctcacacccataatcccagcactttgggacgggcagatcatgaggtcaggagaaaatcctggctaacactaaaaccctggctctagtaaaaattaaccgggtatggtggcacgtgcctgtagtcccagctactcgggaggctgaggcaggggaatcgcttgaacctgggaggtggaggttgcagtgagtcgagatcgcgccaccgcgctccagcctgggcaacagagcaagacgccatctcaataataaataaataaattgaatttccttcataattgaccttatgatgtgtatgtaatttttttaaatcacagcttttatgagatttaattgagatggcatacgatttacccatttattgaagtttattaaattaagtggttcttagtcctcgcagaattatgcatcagttatcactacctaattctagaacactgttgtcatccccaaacaatacctattagcagtcactcattattcctccctgtagccaccccaggtaatcactaagctactttctctatgggattgcctcttttggacatttcatataaatggagtcatacaatttgtagcttccccccccaaccccacggagtcttgctctgtcacccaggatggagtgcagtggtgcgatcttggctcactgcaacctctgcctcccaggttctgacaattctcctgcctcagcctccttagctgggattacaggcgtgcgtccggttaatttttgtatttttagtagagacagggtttcaccgtgttggccaggctggtctcaaagtcctgacctcgtgatccgcccgccttggcctcccaaagtgctgggatttcaggtgtgagccaccctgcccaccctatttacctttttaattgttgggttgtaaaagttaagtttttctgggtacaactatcttatcaaattaatgatttgtaagtactgtttcccatcttgtgggtttccttttcactttcttggtaatgtcctctgacacaaaagtttttaattttgaggaagttcagtttacctatttttttggtcgcttgtgcttttttatttattttttactttgcttctaattcaccaagtgcaacttgtgcttttttagtgtcacgtctaagaaaccactgcctaacccaaggttgtgaagatgtatgccttaattttttcaaagttttctagttttagctcttagtttaggtctgtgattcattttgaatatggtgtgaagtagggtcctgattctcttgcctgttgcatagtgtgtttttgccctacacaggtcaattgtgtcttctgtaatctcacctaaacaccatttgcgcaaggttttcatagctatttgggggccattaaaaataatgctctgatgaacgtcattcaatttctgtgcccaggagctcagcttagtcagcacagttggaattagacagattttgtcaacctcagactgcctctgttgccatggaaaggtggcttcctggcagagcagctagttagcacaagtggagggcggcacttcatgtactcttttttttttttttttttttctgacagagtcttgctgtgtctccaggctggagagcagtggcgtgatctcggctcactgcaacctccacctcccaggttcaagcaattctcctgcctcagcctcctgagtagctgggattacaggcgcgtaccaccacgcccagctaattttttttttttttttttttttgtattttttagtagagatggagtttcatcgtgttggccaggatggtctcgatctcttgacctcgtgatctgcccacctcggcctcccaaagtgctgggattacaggcgtgagccactgcgcccagccttcatgtactcttgtgtggaatggtgcctgccagagttgcatagcccagcagttttggttctaaaccttatgtcccaagaattttgactcaaactttggaacatgatttgtcaggtgtggattcttgcaccttaaaattgtcactagttggtgtgtctggcctgctttgtgattatgaaacttcccacaagtactctaagggatgagtctctactacagcccttgttctttgtgaggcattcccttccccgttccagggctgctctcggtgtttagcagaggcaccctccatcgcttcttcctttccttgcagggcaaattttctgacggggaaagtctcttaaaggggcttctgttccatctcaccagcctctcaggtccttactttgaccaagggttccctggaaagaccagggtgggcagtgtcagctggctgtggccatgagatgcccagtcagcacatggcagtgagccctggggtactggccctgttgggagtaacccatgcatgacttgtttggctgagataaactgaggccagctttggcttccagcagctggtacatggtaggcacacttcagacctgctgagtcactcaggattggatgtaggcacccagcctagtttgaagttctgcatataattcagccagctaggacagagacattgtttcaatacgcctttttaactgtagcagatttccatgtttatgtgttaacctgctcggttaaaaccatgccttgtctgttttgccttgtctgttttcccttgccgttttagaatcacggtcactttcaacattaacaacagcatcccaccaacatttgatggtgaggaggaaccctcgcaagggcagaaggttgaagaacaggaggtaagctaatactataatcagcttttacctcagttctgacaggctgtgcctggggcttagaggaggagcgtttttctttggtctttcaaaaaaaaaaaattcctctaagtccagtcgcatggctcacgcctataatcccagcactttgggaggccgagacgggcagatcacgaggtcaagagatcgagaccatcctggccaacatggtgaaaccccgtctctactaaaaatacaaaaattagctgggcatggtggcaggtccctgtaatcccagctactcgggaggctgaggcaggagaatcgcttgaacccgggaggcagaggttgcggtgagccaagatcacaccactgcactccagcctggcgacagagcaagactctgtctcaaaaaaaaaaaaaaaaaaaaaagagagagagaatggcaggggcataagagactttaactggatcatgcctactcttcaaacatttcaggaagtgctgtgcccagcctagtaaccagccagtatgagggccacagagtccctagacattctgcccaagagccatcagtacagtgttgggtcatgacctggtgtggacggcgcagctctctggtgtgctgctttcccagccaccccaactagcatctccctgacgttggacccagtctgctcccagagctccgcatcagaggaaaagctgctgctgttattcagccataaggatggccaggttccccagcctttgaccctggtcccttatgaagactcctggaacagtcaagctggaaagagatcttgaaactttaggaaagctttgcagtgtacgggtggaggaaaaggcttggaatgttaagggactgatataaactcagttaattggcacatagctgaggctggtatccacatttcttaactgaaaacccagtgtgttatttaaccaagcagggtgccaacagaagtgagatcaagctcttcatttgggaatagtatggcataagactattcaaatggctacataatatcctaatagtggtggccatcagacactctgaacagagatccttgatccagccatccatctccttccagcagcagcatgtattgacttcttgtttccccagcctgaactgacatcaactcccaatttcgtggttgaagttataaagaatgatgatggcaagaaggcccttgtgttggactgtcattatccagaggatgaggtatgcaggatggagtgctagcctcttggcacccctggggaacagtgtgtcccttgggaacttcctgtccctattttagcagaaatttaaacacttttctagcttagaccagcccagcagggggagagaggtggggagtgagggaagagggttaaaacctgatgagtttcatgctgtcagtggccccctttcttcccctgagtctagcttgtcctggagaacccttcagtttcccaatattgtttcttctcaggttggacaagaagacgaggctgagagtgacatcttctctatcagggaagttagctttcagtccactggcgagtctgaatggaaggatactaattatacactcaacacagattccttggactgggtgagtgcttgataaggtgggggaaccttttgggccttggaaggaagggtcctagttcaaggggagaaaaaagcattttaatgttcattacagatttttttttaactagtaaatattgttctttgcaggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaaggcagtttgtctttttctattcctcccccttcaacctgcgtcacaaaagaccaagaacagatgtcggaaaagtttttttttcttcagtattgtttaaaagtttcaatacaaaataagttataaataaaaggcttgtatgtacaaggctcctcagagggaatgagttgtcttcaaccccatagaatgatgtgagtccaagctggctctagaggatcacagcccaagtatcacaggcctaggtttaaacaggaaaataattagcttaaattgtattctagtcatgaaagatatctgataaaagttgtaatcaatgagaattctacacattagatgaggtctcctgagtccagtttcaattagttcagtagtgtagtttgtcatgatgaccgcccctctttggcattgctggacctctgtcctgcagccttcaaacaactgccctgggaaccatcagcatcaatagtcttcaagctaagatcaaatcctgtagatgaactaatcaaacatcctcaccatcaggaaaccactgaccagaaagattgtattcaaactcttgatagcctggagcttttagagcccagcaggaagatgagactccaaatctacacaagattgaagcaggtatgtatcataggggaggtgcaaaccatgcatgatcagtacgggcagaaaacatgtaaagacatgatcagtaagcacctgagtgtaaaactgcctcccgactcctgggtggctcagcctctccactatgctaaggaatccagtctgtccttaacccatttatgccagaggttgcaaatttttttgtgtgaaaaatcagaccttggcgatgaccttgagcagtaggggatcaataactcccacaggcttagcgttccaataattaaacagtaggcataagtgggttactcttgtttcttaccacttccacaggtaatatgtttggctttctctaaaagacactgtaactctgctaataggcggtttggcatattccatcccaggaccaccacttgagcaccgccacatccgaaacattcctcgtcttgtgatagagtgcaatcttctgtaacccacccctatctttcaacacatcctcagccatctgtcctgagcgtccctacgtcctgacctcactggattctaacacaatggtccttgattcccccttaagtgaaaaccaaaggtctagtggaactagagcattccaaatgtctacctttccaaatgttgaactcaagacctacagaatacaattttgtctttccccctcctcttttttttttttttttaaggcacaatctcgctgtcacccagcctggagcgcaatggcgccctctcagctcactgcaacctctgcctcctgagctcaagccatcctcccacttcagccttccgagtagctgggagtacaggtgcgagccaccacacccagctaatttctgtatttttagtagagacagggtttcaccatgttgcccaggctggtcttgaattcctggcctcaagtgatcctcccacctcagccttcctaaatgctggggttacaggtgtgaaccacagtgcctggctgtgtttctcatatttgctgtgacccccacctcccctcacttacccaacaatggtcttcctgcccaccccagagccggcactgtcaactatgatctccaagactgctgcacagcactcaccttccaaacctcacctcctacttagcttcactgctgctctgagccacagggcactgacggttaggtgagtggataactggggtccataacaattatatgctgagctgaagctgtacacttggcaattaggccatcttccacttaccttttaattccccttctcttcccccgaccagcattttgtctttcacactcaaggggactttcatactcaaggagctgtagactccagctctgctaccattataatctgtgtggatgactcactgttcaccttactaagaagacagaagccaaagccagctgacctgtgcctcaactctcctccctccaccttaactcatttgtacaaacatcttaagcacctctttattaatatatgccaagcactggaaataaaaataaatatgggccttgccctcaaggacaaagacataagcaggtaactacaacactgttacaggtgacatggcatgaggtacggtgaaagcccaaggagagactggccagttcccctctgccagccctcattaggtttattgagaatggtaacacagactccaaaggaatggacttcccaggctggccaattctttttttgtttgttttgctttttttgagatggagtttcactcttgttgcccaggctggagagcagtggcgtaatctctgctcaccgcaacctccgcttcctgggttcaagtgattctcctgcctcagcctcgcgagtagctgggattacaggtgtgtgccaccatgcctgactaatttttttgtatttttagtagagacagggtttcatcatattggccaggctggtcttgaactcctgacctcagatgatccgaccgcctcagcctcccaaagtgtggggattacaggcgtgagccaccgcactcagccaccaattctgtttttgagacagaatctcaccctgttgcccaggctggaatccagcagcacgatctcagctcactgcaacctccgcctcccgggttcaagcgattctcctgccccagcctcccgagtagctgagattacaggcacccaccaccatgtccagctaagttttgtatttttagtaaagatggggtttcaccatgttggccaggctggtcttaaactcctgacctcaggtgatctgcccacctcggcctcccaaagtgctgggattacaggcgtgagccaccgtggccagctgagactggccaattccttgtgaggaatcaggctgaatgaagtacacggcatattgtagtgcttggtaaatatttgtgcaaatgatccttaaatgtagtgggaggagtcaaagtcattcagacagaacagcctaaacaacagcacagaggcctgaaagcactgcatatttgagcatctgctaccagtgctggatagctggaacagaagggaacatatgcttgtagtcaacaggaagtagtgaggggttttatttaaactttcacctgctatgtctctttccatacaagctgatggaaaatggcatccttccaccaaggcctgagcctggagcaggaaacagcaggggcactggaaccacaaagacctggggtctaacaccagctctatcgcttattagtagtaaaattttggccagattacatcacttctctgaatctgtttcctattcctaacaggaactatcctctccctcatgaacctaatgctccagctaagtagaacaagatgctctttgtatatactccagtttcctgcttctctgccttgttcttctatgtggggatcttccacttaagctctacccccacaactcaccagatctccatgtctgtccagatcgattccatgcttcaaggccaagttaaatgcctcctccaggaaggtgtcaccataaaggagatcaccctcctctgaactcccataagccctccttgtacagctctccagggtactgcctgtttattctgttctcttattaccaacccaaggcttgagctctgtgagagatgtgtatttctcaatgttaatgagtcctcaattcattttttttttaatgaatgagtagaatacctatggaagaaacttgataaaggtgaaatggctgttaccaggcaatgctgcttataataaaaatgacctctgtaggttaactgcatttggaatgacagggccatgaaggaattctaaattcccagtagaaagccatggctatgaacttcctgaagtacagtgtgctcctaatcccaaggctccccctgcctgggatctaaaagcaataataatacgtatcatattggttttatgtgtgtttgtgtgatatatatacacatgtacatacatacatacacatatatggaaaggacatggattataagagatattggttcctatagcacgcttctaagacaggtggttcccttacccacttgtgttcctggccctcacacctcagttgtcactcaggttagcgaatagcccttggacctctgtaaaaactccactgacagacaaacctaatgctgccctgctatgcttctgccctgtttccttccgcaaaagtggtgccagcatggcctatctgggtcttatgactatgaaatgaccagctgaatccaaaaccactactactgatcaaagaagagcaggtgtggagccaggcgtcctaactcccagaccaatcctcttgccgtgatcccatgctgcctcttcccttctttctgactggcctttgagtctaaatgacttgttaccttcacttttctatgcaggtaaattcctcagataataaactgcattaaacatttacctgtttataggtcattatttctatcaaggtgggaataaaaccaaccacaggtccctcttaccacagagtgggtcccaggagacgcttaccagacagctcatgagaagactggacttttcttctgttcctccagtgactgaaaattcaggtgtgtggggacaatgtgcactgtgctcatttatactaccctctaaacaggcacgaagcttctgctctgtcaactcagaagactacaaaataaaaaagttcaacctcctctcagtgacttgatagccaacagatggaaaatcctcattcctcatgccaaccaatataaccgtggctcactgtgatggcttgactccttggagccttaaagacactcgggcccatgactgtaccaagatctcttaacccatctccatttaactgcctctccagattaaccaacgccctctactcctgctgtcaaacacactgatggccactcatggcaggaagaacgctcagagattgtaggctactttccagcctccctctgcctctgcccccaccagctgagtgcatccttaccaacaactagcagtatatgctcccgggtctgcttgggttacttgaacttcctactgtaactcagtaatgctaattacttattatgtaaataataagttttatttttatagtgataagtagaatgtttaggaaacaaacagatgagctgcttaaaaaaaaaagaaagaaagaaaaagagctatagaattaggtaaaagatggggaggaaaaattcctaagttgtatactcagtttcttgatccactttatggaattaaaaccggaaactctggactatgtattatagaagttgtttatgtaaaaaaggtgactcagcgaggcacagtggctcacgcttgtaatcccaacactttgggaggccaaggtgggcagatcacctgaagtcaggagttcgagaccagcgtgaccaacatggtgaaaccccgtctctactaaaaatacaaaaattagccaggcatggtggcacgtgcctgtaatcccagctactcaagaggctgaggcaggagattcgcttgaactcgggaggtggaggttgcagtgagcagagatcacaccactgcactccagcctgggtgacagagtgagactctgtctcaaataaaataaaaaataaaacaggtgactcagctctccaatcagcagggccccactcaaaggctggcaaataaatttatgtgtttgaaacttaccataaaacattttatttttataatttgcctctttaaccaatcgctcaattaactggcaaacttgcagtccccatcatgccagataaaagggctttttctgtattttaagattactgaaggccgggcgtggtggctcacacctgtaatcccagcactttggaaggctgaagtgggtggatcacgaagtcaggagttcgagaccagcctggccaagatggtgaaaacccatctctactaaaaataaaaaaaaaattagccgggcgtggtggcaggcacctgtaatcccagctacttgggaggctgaggcaggagaatgacttgaacccgcaaggcagaggttgcagtgagcctaaatcacgccactgtactccagcctgggcaacagagtgagactccgtctcaaaaaaaaaaaaaaaaaaattactgaagcttaaattctgaattaggtatgtcttcatatatagaaaatttttatgaaacgtcagatacaggcgttaccaatcccaagctgaggtctccataaaaacgttaagcggtgatggctctccagggccctaaaggctctgatgtgtactgtttgccaattttcatgccatagatattctcaccatggctgatttgaagctaccaatgtgacaccactgaacataaaactgggaagaaatatgcacaatgggctccaagtcagcactggaggatcttcaagaaagtagatccatgtgggaagaagtatcatgaaatctgtgtgtggaacactcacatgagatgggatggacaggccacactgacacaccaccacaccgcttgtgattctcaggttgtacctagaagcagaattaggatcccagagcatcatggccaccagacctggatctccaaaccttgaatttcaggcaacaaatctggggggagattccactcaccttggagtggggaatgggaacgaataatgctgaaaaggttttaaaaactcttactttgtacatacaggacagatgagtgggtttgcctcccactcagccagcatgatgctgagacacttttcatcaaactgcaagctcttctcatactcgctgatgatggactgctctgcaaggcaaaggcagttggagggcttcaccatgcttcagctggccctgtatttaattctaaacttcactgtcaaaggcttccttcacacgagggaaagatttgggcaagaccacaataccaatgactggtttttatgctctctcaggctggcttcatcttgctggattcctctccctcctctctgtcccctttttgtgagcacaagaggtgaagtaggctaagggccgaggagacaattttcacacacatctccagaggccataggagcacagatacagaatgtcagggtcccacaggcaactaaataaagttgacaaagagaactgattgctggccgggcacggtgactcacacctgtaatcccaacactttgggaggctgaggcaggcagatcactcgaggtcaggagttcgaaaccagcctggccaacatggtgaaacccatctctactaacaaacacaaaaaattagccaggcatgtggcgcacgtctataatcccagctactcgggaggctgaggcagaagaatcacttgaacccaggaggcggaggttgcagtgatccgagattgcgccactgcactccagcctgagtgacagagcgagactctgtgtcaaaaaaaaaaaaaagagagaactgatttctgatgccaggacgaccctgctgattccacatacttggaatctgtgttgttcagaatctgtgtgctcattcattcagcaaacatacaacagtacctagtatctgctagtcacaggggcacaaagatgaaaaagactgtcattgttgagctcacagtctagacattagggaaggggtcaaaaaactacagtcacgcttatttgtttatgtagtgtctataactgcttttccactagaactgcagagctgagaaattgtgccagagaccacatggtctgtgaagtctaaagtatttgctatctggctcttcacaaaaagtctgccaacttctgctttagaatgttccttatggctgagtacagcacaacacagtaaatccttgtcacttcagacttattagttaagtatgccccaaaataaaacatttggtcaggcttatgtttcaccactaagataggttttgtaggtgggggaagggaaaatcaataaaaaaagatgataacttaaggaatttacagtctaaccagagtcgacagcaacagtcattaacaactaacacttgcatggcacttatgtgtcaaatgctattttaaattccttacatatattaacttcttcactattattatccttatttcaaaggtgaagaaactgaggcacggggaaattaagtgctttggtcggtgccacacaaattaaagtagtaaagccaagtgaatgttagaggtatgactcaagagcttgtgctcttgcctcaccataataatagctgttgattattgaaagctctctatatgccagacaatgcactaagtcttctacacacgttatttaagccttacaacaaatttatagggtattctctccattttataggtcataaaaatgaagcctaaggctgggggccatgcctcatgtctgtaatcccaacactttgggaggctgaagtaggaggatggtttgagtccagctgtttgagaccagcctaggcaacatagtgagaccctgcctctacaaaaaaatttaaaaaattaggctaggcattttggctcatgcctgtaatctcaaaactttaggaggctgaggtggggggatcacttgagaccagggaggagttcgagaccagcctgggcaacacagtgagaccctgtctctacaaaaaaataaaaaaattagctcggtatggtggtgcacacttgcggtcccagctactcgggaggctgagatgagaggattggttgagcctaggaggatgaagccacagtgagccatgattacatcactgcactccagcctgggcaacagagcaagaacctatctcaaaaaaaaaaaaaatacataaataaaataattttttgtcttgtttttatcatctttagctaaaaaaaaaaaattaataaaaaaaaattagccaggggtggtggcacacgcctatgatcccagctattcagaaggctgaggtgggaagatcgcttaagcccaggaggtcaaggctgcagtgggccgtgatcacgccactgcattccagcctgggcagagaccctgtctcaaaaaaaacaaaaacaaaaaccaaacaaggcctaatcaaatcagggctacatggaataaatgacttaactatataaggtacaaaattatgctctctacaccatgctatggacacctccctcaaggagtggatgctcacaggccctggggagttaatagagaatgtggcacttaaaatgaatagggcaagggatcagaccatgcactatcactgtatcctgtaaaatggcaggtttacttttttttattttattttttaaagtgacagggtctccctctgtcagccaggctggagtgaggtggtaaaattatagctcactgtaaccttaaactcttgggttcaagtgatcctcctgcctaagccttctggctgagggaggctacaagtatttgctaccacacccagataatttttttttttttttttttacttctgtagagacaggatcttgttatgttgcccatgctggtcttgaactggcctcaagcaatactcctgcctcagcctctcaaaatgctgggattacaggcataagccaccaccctcagtgaactattaacccattaatagagaggcaggatggtagaagaaacatgggaactggattcatacaactgattttgcttcccatctcctccacttactagctgtatgacctgcacgagaacaccaaccaccttctgttctaatactactatcttacagggcagtcacatggagaaaacagcatcattaaatgagaagttcttagcacaaggtctagcaccctggagacccttattattgagaagctagacagccaagatgtcagagtacaaaaggagtcttttggacacttgactgatggaggtagacaaaggggacttataaactaatcctgattggaggaaaggtcacagtattccagtagctaaatacaggtaaggaaggactaccactaggggttaccttggttgatcagctcctgttgaatttcctccagcacagccatgtctatcagctcctccagctggaagagaaaggagcggcatcagaagtttgaagtattaatcaccaaccaagccccacagtgattcatacttggaggctggcttgaagaacccagatttattggacaaaatcagtccagtcctcctgcagaatatgctgacagtggggtaatgctgtcatgctgacaagccatcaacaaatgatccaactatccagtgacaaaataatggtacccaattttggagagacgatatagggtagcagttaggtacatattcttccaaggctacgtaaccacatgaaaagttcctaatctctgcaaatctcagttttggcctctgtaaagtgggaataaaatctatctaagagggttactgtgagtactagttgtggtgatataaggcaaacattggtgtactgcaggacacacaaaagccactgaataatgcatcattattacacagggtgttgatggtttcaaacagttgcccacattttcttacacagtccttacaatgctgaaaacattatcttctcattttataaatgtgaaaactaaacctcaaagaggcaaactgaagttaacagtcaatagccaaaccaggatttgaattctggaactcctgacttcgaatccagtgttcttcctgatacactataaatggttttcccttccacacatggctgccaacgttggctgagattagaatcggaaagtttctggagacctttttagaaagagattcctgacgtgggcagatcactagaggtcaggcgttcaagaccagcctggccaacatggtgaaaccccatccctgctaaaacagaaacaaaattagccgggcatggtggcacacatctgtaatcccagctacttgggaggctgagacaggagaatcgtttgaacccaggaggtggaggttgcagtgagccgagatcttgccactgcactccagcctgggcgacagagcaagacagaaaaaaaaaaagagcgagagagagggagagaaagagattcctagcctatgcctactgaatcataatttccaagggtggaggcaagaaatgaaatttctttctttttagtttcataaatgatgatgttgcagtgatgagcaggtctacggtctggtatttcagaccatttcatctagacaagtctaacattaagtgtagaaaagcctgggttaaaggctgttgaattctaaatggggttaggggaatggtgggtttagaggactcaagtaaacaaataaaagaggacacgagccgttcttggtggtgcagtccccctccctgaaaacacatagcccagcctgacctgagccaagtcttctggacaattctccactgactgcaaagcattccactcttcttccatcacctcttgaactagaaagctgttctgagaattccctggcccactgcttccagcctggcggtacctgtttaggagcctgtcccggctgtttctcattctctccaggcatctctgggaaaaaagagcaagattgggggggaaaaaaaaagcatttctatttttaaaaaacactcttacattagttgagaaaacattaaagaaagtttatagacacaaaatttcaatgataatactaactagtgttacttttgcatattcctctgtagagatacataaaattacaatgctttgtacacgtatttacaaagaaccatattttttattctagcttgccagtttccttaatggttgtgtgcataatatctcagcatccaatgtcctattacagaacatttatattccttccaaattcttgctactctagatatggctgggtaacggccttcctgcacagcagcgtttctgaactcagggaggttttgtcccccaaggaacatttggcaatgcttggagacatttctggttgtcacaattctagttataggactattagcatctagtgggtggaggcccgagacgtggcttaaacaaccctccacaacatataaatatctccctcaaaatgtccattgtcaaggctgagaaactctgctgtatctgctatctttcttgcgtcgggttactttcttggacattacttactaataaccacactgtgttcagaagaggccagaactgaggtggagccctcttctaagcctcattttactactctctagaatagaaatcatctctatctcacaagacgaacgtagacaaagtgcctctctcggtggccacctccgcagcaacagtaggtagtgttattgcagaggtgcaaacggtgatgtcctgaccacaatttaaattcaaaacaaaatcgaatccaaaaacaaggctttctaggacttgaccgacccgggctaatcccacactctacagtcagcaggcctgggtttgaccagaccaggcgcgctgcggcacctgctccacggagcagggctaaggcgaaggcagggaagacggcggtcaccgggacgatctagggtagaccactgcacaaaccccatacccacctgccggaaagcctctttccaaggcggcgagcccaccagtttgtacagggagcggcgcggagacctcaacgactccgccatctcctcttcgcgggagacaaagccacaagacccgttccctggaggcgcgcacagacccctgggaggtgtactttccgggtgcagaccgcgaatggatcgcagcgtattctgggaagtgttgttttatcgaccggccccacgtggagacagatttaggcatccaagcgaaatgcgtgaggccagcccgacctgcactgagggaggtaagtcttgagggaaagttctggatgcctgggtttacccagatggaggtgtccaataggcaattagatacacaagtctcaggctctccccaggtgctagatttccagcagcaccaccattatgttgacttctcgtcccgcccccttgggcttcagaaataatggtgattggctttcccttggtgacgcccctgcttggtgggctggcctcgccttcgccccccgacctggcacgagcctctcgagcttccgggccgtctgctcggtgattggccgaaacagtgagtggacggccgcggattggctgtgctcagcggcgggctgagcaactggagtgaggggagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccaggtaatgccaggccgatcttggaagtgaccctcaccgggatcggaaccagtcttttttgttccttgctcctcttggctgtttttcatcttgtggcaggcgttccagcggattgactccgacgctgccatacgcggtcgcggggactcaggctctctcgatgcttacggcctggaggcctgggaggaaggaaagggtcattgaatattcaataaaaatactagtgacggatgagtgctctggagaaaaacaaagcgggctaaaggggttgagaacgagtgggcggagttgctatttttagtttcgtcgagagaaacctgtttcctgatgtgacgcttataataggttagatcgtaactttctcttgcgttgtgcacagcaagtcaggttgcaggtttcaaagcaccacgcttcatgcttgacatggaggaggaagtctctgttaattcttacccccgtaacgcccgctttagaaaataaagccatacccaaaatggggatttttgtttttgattagccgacagcatgtgaaaatgggtgtgatccagaaagtattacacacttgccgtggtcaaatattggtttatggaaatgtttatttgtaatacacagattctcttaaagatgaaaaagagcttggtactcattctaaggtatgacatctgttgtgtgcccggtccaattcttgttaccgagaagtgatttaattttaataagacgctagcaatgcttctgcagttttgaaaatagggcaggagtctacagtctacttatttacccaatttcagttaaaaagaattatgaaggccgggcgcggtggctcacgcctgcagtcccaacactgggaggcagaggcaggtggatcacctgaagtcaggaattcgagaccagcctggccaacatggtgaaaccccgtctctactaaaaatacaaaaattagccaggtgtagtggcgcgcccttgtaatcccagctactcaggtgcctgaggcaggagaatcgcttgaacctgggaggaggaggttgcagtgagctgagatcacgcccctgcactacagcctgggcaacagagcaagactgtgtctcaaaaaataataataattaccaaatgtgcagcacgcagtattctaataacattctatactgctgtgtagcatttgacataatcataacttaattatttataattattttgtgtcttttttttttttttgagatggagtttcgctcttgttgcccaggctggagtgcaatggcgccatctcggctcaccgcaacctccaccttccagtttcaagcgattcttctgcctcagccccccccgcgagtagctgggattacaggtatctgccaccacgcccgactaatttttgtgtttttagtagagacggggtttcgccatgttggccaggctggtcttgaactcctgacctcgtgatctgctggctttggcctcccaaagtgttgggattacaggcgtgagccactgcgcccggctgtttttgttttgttttgttttgaggcaggatctcgctctgttgcccaggctggagtgcagtggtgcaatctcagctaactgcaacctccacctcatggattcaagcgattctcctgcctcagcctcttgagtagttgggattacaggcccactccaccgtacccggctactttttgtatttttagtggagacggggtttcaccatgttaaccaggctgatctggaactcctggcctcaggtgatccacccgtcttggcctcccaaagtgctggcatttcagccgtgagccatggcactctgcctctgtcttcttttctagactgtaagctccaaggcaggggctgggtctgcccttgtcattttttaaaaacgtattttattttttatttttgaaatggggtctttctctgttgcccaggctggagtgcagtggtgtgatcacggctcattggagcctctactgtcaggggtcgagtgatcctcccacctcagcgcctggaagtagctgggactacaggcatgtgccaccacgcctggctatttacttatttttgtatgtccagcatacagaaatgctggagtgcccagaatttataagctttcagtaaatattggtgactatctcaataaccttcactcctccaaaatctcaaaaccttagagatggggaagaaagcagcttatcatgagttgtaactttggatgttaaaagcaagcatgagtaagctgggtgtggtagctgtagcctataatcagcactttaggaggccaaggtggaggcaggtggatcttgtgagcacgggaacaggtgttcagaccagcctgggcaacatgacgaaacccccatctctacaaaaaaaacctttttaattagctgggagtgatggtgcacacctgtagtcccagctcctctggaagctgaggtggggaggacacttgaacccccatagtaaagtctgcagtgggctgccactgcactccagcctgggtgacagcaagactctgtctcaaaaaaaaaaaaaaaaatttgtgagttaatggtacaagtgtgagtacttatccagagttttattatcctataattgtagtaaactaagtattactgtgatttcaagtaactgccacctatatttaaattaaaattaactatgttgactggtttgctctaattttcagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtaggtaagttgtatactatttatctgtataatttattatatatacagaaaattgttcaagactagtggttcttaagcatgtttagtatactactcttaaaacattaaaacactcctcgtggtctgcagactggcttctgtgttatcaatgttcatagtatatgtgtaattgattgtactttattctgcctgaagtaccacgttgctgtctcatttgaggctaggccattctttcgattaggtagaagtaagattttgtaaaaccagttatctgtcagccagaagtttgccagaagtgtaagtattttatgtgtgtgtgtgtgtgtgtatgtgtgtatatatatatatacttttttttttttttttttttttgagatggagtcttgctctgtcacccaggctggagtgcagtggcacaatctcggctcactgcaagctccgcctcctggattcaagcgattcttctgcctcagcctcccgagtaactgggattacaggcaagcgctaccatgcccagctaatttttgtatttttagtagagacggggtttcaccatgttgaccaagctggtcttgaactcctgacctcaagtgatccacccaccttagcctcccaaagtgccggggttataggtgtgagccaccgcacctggcctatttttatataatttctttttcaacaaatccagaaaagtgaatctgaaagatctactgaaaagagtacagatgcttttcaacttacgattgggttatgtcccgataaacccagtgtaagttgaaaatggatttattgctgacaacacagcagaggatccccgatttaggatggttcaacgtaggatttttcaacattatgatgggtaaccccatcataagtcgtaaggagctcctcagtttatgttggcttatgtactggtaaacccattgtaaagttggggatcatctgtataaggtagaaactgcttttagctccgcaacttataagttgagtccccttaaactgtttaccttctaaatctgtttcctcattttaaaaataggattgataatatctgcccttgtaatttccttacagggttagtaaaaagatcaaatgagatactatatctgaaaacacttgtactgtataaatatgtatcaatcctaagtcaaaccatcctaaaatgtatatatacgtatgaaatatgctataatttggagccaggcacgatggctcacacctgtaatcccagcactttgggaggccgaggcaggtggatcacctgagctcaggagcttgagaccaccctgggcaacatggtgaaacctcatttctactaaaatacaaaaaataagtggggtgtggtggcacacgcctgtagtcccagctactcaggaggttaaggcacaagtattgattaaatccaggaggcggaggttgcagtgagcaaagatcacgccactgcactccagcttgggccacagagtgagacttcatctcaaataaataaacaaataaaatttaaataaataatttaaattattaaaataaataaattatttatttattttgagacagagtctggctctgtagcccaagctggagtgcagtggcgtgatctcagctcactgcaacctcctcagcccgggctggagtgcagtggcacaagctcagctcactgcagcctccacctcctgggttccagcgattcttctgcctcagcctcacgggtaacgggttacaggcatgtgccaccacacttgcctaattcttgtatttttagtggagacggggttttaccatgttggccaggctggtctcaaactcctgacctcaggtgatccacctgccttggcctcccaaagtgctaagataggcgtgagccattgcgcccagccagtgtgctataatttagaagatatttttatttcaattctttgatattgattgaatagatgccttgaatgtcctctcagcatgatttcagggaaataaatctgaaggaaagagaatcaaagagtgttaaaatagaaatttcttcagggcctggcgtggtggctcatgcctgtaatcccagcactttgcgaggccgaggtgggcagatcacctgaggtcgggagtttgagaccagcctgaccaacatggagaaaccccctctctactgaaaatacaaagttcgctgggcgaggtggcaggtgcctgtaatcccagctacttgaaagactgaggcaggagaatcacttgaacctgggaggcggaggttgcagtgagccgagattgtgccgttacactccagcctgggcaacaagagagaaactccatctgcaaaaaaaagaagttcctttagaagattttcatccaagttgtacaaaatgttttggaaaattattatctttattttagtaccactccagttgcggagagatttttcaccagttccacctctctgactctaaagcatgctgcatggtatccaagtgaaatcctggatccccacgtagtgctgttaacatcagacaacgtaatcaggtaaattttatttctctctcttgaagccttgcgagtgggaaagctctgtttctgtttgccaattaacagctcaacatagaacgaagtgagtcattgaatgagtcagtgcttttattggatggctgttgtaacccattctcaatcataagaattgcctaactgctctaacttaccactattccttctcaactagtcttcctgcctccaggtatctcctctcctaatctgacaccttagaataatctttccaaaactctttcatcattgtcacccttttggtaataatgtagcataaaggaaagagaatgtaagtgtaaatttagagatttgaattattgtcccacctccttttctgttatctttgagatcttgagctttttaggggttggggggctcagtttccaatcttttaaattgagcaggtttgattcaatagtttctaacgccccttccaagctttgcactctatgattaaatgccctaatgctacgtagatttctactctattatcagctaactttctggatcggccttatgtaaaaagttattggggggactcagcagaggtacagataccttcagttttatttttcgtaatcactgcttttaactgtgctctactaaatcttccttcactgctgaatgactcaccccttaatgatgtcttatacagatccccatagctttctcgttacttctagttatgaaaacagtgtgtccagtttaaaactcatcttggctggttgcagtggctcacacctgtaatcccagcactttgggaggccgaggtgggaggatcatttgagcccctgagttcgagaccaatgtgggcaatacagtgagatcctgtctctgcaaaaaaaattagctgggcataatggcatgtgccggtagtcccagctactcaggagactgaggtaggaagattgcagcctgggtgacagagtaaaaccctgtctaaagaaaataagaatgtcgaaagctatttgatctcaaatctttcacaactatgtcctggcccttttgtaggtcagacctgtgttttgtgggatcagaagtgattggagagtgtgcggtctgctctttcactcttcctgttatcccagcactttggaacatagggtgaagtgtaaggaatgggctgccccctccttcctccaaatctaactccttcagtgtggggtaggggagtgggacaggtgaggtagagatcttaccgaactggtagcctgtgagtgatggggaagtatgcctgatcttgtttgaatctcgttccatctgtcactagtgaactctgttgatgtggtagtctctgcatagatggtgtgtttgtgtgtgtgtatgtgggggggtggggtggtgttggagggcagtgttgaacttccagctccccccatcactgaggagctctggctcccattggctcctgtcagttctctatgccctgaatcttctctcaagatggggtacagtatactttatctgcagggtgtgtgttccaagaccccccagtgaatgcctgaaactgtagatagtactgaacgtgatacgtgtgtattgctatgttttttcgatcttataactgagacagctactaagtgactaaggggcattcagctaggaaatgcaccagtctcccttattacaggtacctccacatctggctgtttcctagagccttccctgcccacccatttggctttagagttcagggcagagaaagaggagagggaaaatcttcccattacaaacattatactgtactcctaaggaatctttgacatcctctcttcttagtcttccttttatatgctatgatggaaaaggagatggtgggaagatagcataggtacagttcttaagccccaaaggaagtatctggccccaaatattgaaggttcttttttaaaatatgtggtatttaacacttctgttttcctaagctttggagattttgggcagtttcagagcaaaaggaaattttcaccgaatgccctgttgcaccttctttttctttcactgttccccagtacaacattattgcctagtatttatgtgtattttgaagttagtaacgcttgtaggaacctaggaagactgtaataaatgtgtattcaaatggatcaagttatcattaaaaatttattaaatacttaatgtggcattttattgatattggaagaaaccaagttaaaaaattcttagtggcgtcagacaaaataagtgattataagggacactggatttctaaaatgacattactggccttttgaaaattccctttttcacaatagccttatatgctgtgaaatgtaggttactttaaattaaaataattttggttaaaaaaattcagtattatactttcccttgaaaatagagatgatacgatactgggtttgtttgtttggtttttttttttttttttgaaatggagtctcgctctgtcgcccaggctggagtgcagtggcgtgatcttggctcactccagcctccagctcaccgcaacctccacctcccaggttcaagtgattctcctgcctcagcctcccgagtagctgggattacaggtgtgtgccaccacacccaaataatttttgtatttttagtagagacggggtttcatcatgttggccaggctggtcacgaactcctgacctcaagtgatctgctcacctcggcctcccaaagtgctaggattacaggtgtgagccaccgtgcttggccaatattgggtttttatataacaaacacataagtagatttgcaggctaaatatcactcactctgtcagccagttggcatataaagaataagatacagttctttctctggtgggatttggtgtccaataggcagagatagatgtgtgtagttgaaggaaaactggcaagcttaggggcaatagtgagatgactggacaaggcgagtatagctaagggctcaggacggaagtgacagaggtgcgatgttatggaataggctgttaaagggtattggtaaggatagagaacatttcttcaggccccaatgaaactcccttatgtagttaaagaataaatgaactagactactttgcaacagcaagatttttgcaaagaaatagttgtgataagtgttagaaaattctcaagaactgactagatggagaggaaagtgcagttttgggaaatgaaaacagaattttaagtgctggttttcttctcttttggttgctagaatttactcactacgtgagccgcagacacccactaacgtgataatactttcagaagccgaagaggaaagtctagtactcaataaagggtaagtttttatttgagtcttgaaatggttttttaattagcttattgggattataaatgcaattttaacaggttgcaaggtttttcagaggtgactagcatgcttttggtaatgtgagaagtaagtgtatttttagtagaacagggattcgtcgtgttggccaggctggtctggaactcctaggctcaagtgatcctgctcgtctcagcctccccaaagtgctggaattacaggcctgagccaccattcatttctttatcacctttctatgtgataaagaaactaagataatatcttgcattgatgtttgctctctcaactatatgaaattgtgatttcattttaaccatatttgttaactttgtattgaactagaatcttcctgaataactacagtaaattttaaatataaaaacagcatggttttatgatttgccttcttgatatacatgtaatgtatatttgctgtagaaaattgagaaaaatagatcaaagtattaggaagaaaatgaaaatctttgtaatctcctatagctatagcctgtttcaatacagcacccaaagtttaatcacatcattctactttaatctaagtttaatcagatcagtttaatcagatcattctacttccctgctctccataccccattgatttcccagagtctttacctataaagggtccacaggtatgccacctgattgcctttccagcttcattcctccctctgtgccctggctctctgggctccaggcaccttggcctccttgccattccacagacattaagcacttctaccttagagcatttgctctccacctcaactgctccttccctagttaaccacagacttgctctcttacttccttcagatctttgctcaaatatcttatcagagtctttcctataccaagtagtctaaagtagcacctccatcaataccctcttaccctactttatttttcatgatattttctgagtttatgttccatctttatttcttctctttttgtggtatttctctctctagagggcaggacatttgtttaattcactgacatattcccagaccctagaaaagtacctggcacagagtaggtgctttgcgagtatttgtagaacttacggatcctgctgctcagagacaactgttgatgttttcatgtgttttcctgtttcctttttgcatttatgtgtgtgtatataataaatttttgctatttgtatatctgtgtatttaaactatttaagatgagagtagaaccaaataattttatggccagcttttttcacttaatttcatgagaattttttttttttttttttttttgagacggagtttcgctcttgtcgcccaggctggagtgcaatggcacaatctcggctcactgcaacctccgcctcccaggttcaagcaattctcctgccttagcctcccaagtagctgggactacaggcacctgccaccacgcccaactaatttttgtatttttagtagaaacggggtttcaccatgttggccaggctggtctcgaactcctgacctcaggtgatccacccacctcggcctcccaaattgctgggattacaggcatgagccactgcacccagctgagaatttttaaatgttaacattcttcataatcattttttgtcttttcagtccattgcctacaaattccatacatacccacctcctgttattagacattttgtgtttttgttttgttttgtttttctttttactttttgttgtttttgtttttaacaagttggtttttacatctctttccagaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacaggtaagttgaggtggtcacccacctgaaatgaaaactcagtttgggctccagtagatatcattgaggctggacttgggagccatgtttttgagtctgtggaaatgttgcagccttcacatgcttggcttgcatatttttgagaaagagttagtacaggtcatttggcctttcatttcttcatattatttgggtaagttctatagaattcttggataatcacttatgataggcctggatttgtgttcacaaattctagttatccgaacaagtgcttattgtttatcttatatgaacaagacaccacgtaggcgtggtaatctggtatcttatgtcccagttgtggggagaaagatacatacacatgaaaaaatactatccataccacagtattggtacacagacagtaagaaccccgaggaaggagagatcattctgactgggaggttaaggaaattttcgtagagaaggagtggtgtcatgtgtgacttaaaggtctcattcaggattaaatgaagtatcaaggaagagtgagaccatttctgtcaagggcagcataaagtagcgtctgaaaataagcaagtgcaagtgtcattcaagcttaatttattagacattctgggctagagctgaggattcatgtagggagcattaagtgataaagctggagtatctgtcccgagaaaatttgctggaattaaaaatacctcgttaaaagagtgagtgtgggttttttttctgtaggaatagggtagtaggaagccagtgatggtttctgaacagaaggacaaaacaattggttagggaggggactgggacagagacttttaaagaagcttttgcaaaattgagcttgtcatttatgagagtttgaacttgggtggtaatagaacagagggaaaaatgaaacacagtagataacaacaaaggaaggataaataagacttagttactgtttggataagggagtatgccatgaacagaaacaggtcagtaaaggctgctaattgggggagaagatttatttctaagtaaatcagtgtaagatagtattggaccaataaaatggaaatattccatggacagttggaaatacaggatgatgacagacaagaagaattaaaatagaggtatgagaatcatctttcatggtgagagagtctatacaggataagaatttgagggaaaactgcagaggcataaggctaagggctgagcattagagtttattcgcttgtaaatcgacttaacagatacttattcaggacccactctggcagaagatggaaatacaagattgaaggcaaggttcctgccatgtggttccttaactaccagaagggcatacaactaaaccagtaactatagtacagtgtcatgtgctcagggcatcaccgggttcttcaggagtgtgatggagtaaatgagtaggcctgctcatcttggaagactttaaggaaatgctattacaaaagcttgaacttgaaggattcactagacagaatcagaagtgggtacaggagagagaagagagtacgcaaaaccataaagattagaaagatgaaagagctcggtaggttacagaatggtgaggattcactgttgagtgcattctccttggcagaaatgttctctgcctttcacacatgatctcaggaggattttgtggtaactttagtaccttcccttaccctttctcctcttgctgctgagccctcatttgtccaaaccatgatctgcctagtaacgttagcccaaaacccaaaagttttcttcatccttacatttcatcagtcccaaatttctattgattttgtgatttaaatttttcgaaagtatacaccaagcttgtccaacccacgggctgcgcgcagcccaggacagccttgaatgcagcccaacgcaaatttgtaaactttcttagaacattatgatatttgtttgcgattttcttttcttttcttttttttttaaagctcatcacgtattgttagtgtattttctgtgtggcccaaaacaattgttccagtgtggcccagggaagccaaaagattggacacccctgattatacacccttctctgcattcctctgtccctgcttcagaactgcatcatctgcctacttcaccatctgcctggcttattttcttaaatagtttccccaaatcccattttggacccttccatgtcttcctccctaataccagactgatttgtaaagtgaggctccatcgcttgatttaaacctctagtgatatactgttacccggcagatagatttcaaatagtttaacatagcacacaagactgtgtacttcataagccagtcctggatgtctgtctagctattttgccgttgccttccaccttgtactttgcctcccatcatactaaataagttttcttgttcttagttctttgtctttcatgtttccaggactttgcataaactgatctctagcttggaatgctcaacaatccccttcccagaaatcattctttctcatttttctcatttattttttatagctttcttcattatctttgtatctttttgtcattcctttgtacaccataaatccttctgttgttgcacttatcacatggtatagtaattctggttaaatgtctgcctcatcaactaaaccatcattcactgggagtatcatctagcactcaataataagtatttgtcaaatcaaatttaatatggggatccaaagccttgaagagaagctacattttagaagaaaggatttggtagtctttgaatatagatggtagttaaaacgaggcatagtttaacaggctctcatttaagtgtgtattttgaaaaaagtcaaagcatacaacagaatcctggagaacaccaatatttaagagacagaaattagaaaaggacgttagaaaattgtgtttaaagaggtaggaagagagaactacaagaaagaattgttacagctgttgagtagcagtagtcgttaaccagtgataaatgcagcagaaggttaagtgcattttggatttagcaaatctcacaggtgacctttgccacagtagcttcagtggagtggtgaaagcataaaccatagtaaatttagggcaagggttttcaacctttgtactattgacattttggtctgaattattgtttgttttagaggtgctgtgctgtgcgggaatgtttagcggcttctgtctagcctctaaccactagatgctaatacctccccccacattgtgacaaccagttgtgacaagccaaaatgtcttcagacattgccactgtccgctagggcaaaattatctctggttgagaaacacagagtggtgggatctgagtgggaaagcgagaagatggagtattgggaatacactacatttataatgaaggtatgatagctggaggaaaacaaagtcaaagaatggttttatgggatgagcatgcatactgtcaacatttcccaaatatgtttttactccttctttagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacggtaagtgcaggctgctgtggttgtttgtatcttcaacacctggcatagttcctgacccaatatgaatgcttaatatatgagaaggaattttaacttacttatggaacttctgatattttggaaattaaacagttaaaaaagtagctgaagcacacttagcagtctaagtggaaagaagttagaaggttgcccaacttacttggtccaccagtctgcatgttactttctggtctctatattgcaatcttcagggacagatacaaagagccttggaatcactgaattggcttttttcacaaacatcttcctaaaggaagagagacgttttgtcttcagaataacagtgcactgttaggatagaggtggaattaagaatttgaaagtactgtttgacccagcttttttttcaatttttttatttattttttattattattttttggagacagagtttcgctcttggtgcccaggctggagtgcaatggtgtgatctcggctcactgcaacctctgcctcctgagttcaagcgattctcttgcgtcagcctccccagtagctgggattacaggcacccaccaccacgcccggctgatttcttgtacttttagtagagacagggtttcagtatgttggccaggctggtctcgaactcctgacctcagatgatccacctgcctcggcctcccaaagtgctgggattacaggcaagaacagccgcacccggccctgacccagctttttgcctgtttttaattgtgtacattttcaaattaacatgcaagatcaaaattacaacacttttttttacagtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagaggtaagctcttcaataaatgtagtgcttttttcccatgatttttatactaagactatcatagactgttcctatgtaatgtatttgttctgtggttccagcctttaaaaagttgactgggttttttttagctttttagtcactatagtacactttttgtctaaggcagactgagcaaatttcccaagttttaaaatagtggtctttggtccagatcaccagattcctaatagtgaatttttcctggtcctttcaaaagtagaactaccatgttattcagtagttccactactgggtatgtcaaaaggaaaggaaataataggttgaagggatacctacactcccatgcccattgcagtgttattcacaacagctaagatgctgaatcaacctgtgtccatcgacagaccaaatggattttgttgttgttgttgttgttgttgagatggtgtctggctctgtcacccaggctggagtctaatggcgcaatctcgactcactgcaacctccatctcccaggttcaagcgattattttgcctcagcctcccaagtagctggattgcaggtacccaccaccatgcctggctaatttttatatttttatttcatttattcatttattttgagatggagtctcgctctgttgcccaggctgaagtgcagtggcaccatctcagctcactgcaacctccgcctcctgggttcaagcaattcttctgcctcagcctccctagtagctgggactacaggcatgtgccaccacgccctgctaatttttgtatttttagtagagacgggggtctcaccatattggccaggctggtatcgaactcctgaccttgtgatccgcccacctcgacctcacaaagtgctgggattccaggcgtgagccactacgcctggcaatttttgtatttttagtagaggtgggatttcaccatgttggccaggctggtctcaaactcctggcctcaagcagtccacctgcctcggccttccagaagtactgggataacagatgtgagccaccgcgcacctggccccaaatggatttttaaaatgtggcattgtatacacagtggaataccatttggcttttgtgtgtgtgtgtgtgatatgatctcactgtgtcatctaggctggagtacagtggcgtgatcttggctcactgctttgcctcccaggctcaagcaatcctctcacctcagcctctggagtagctgggactacaggtgtgcaccaccacgcctaatttttgtatttttggtagatacgggattttgccatgtcgtccaagctgaaagtcctgagctccagtgatccttctgcctcagcctctcaaagtgctggtccacaggtgtgaaccaccatgcccagccctatttggctttaaaaaagaatgaaatcgtgtcattcactgcaacataggaggatttcaatcttgtagcagtttgacctactctccttacagttcttgttagccagtttgcctagttctggtaataacggcctcaactctgtactaaagtataggcaaaacatttaagggggcagaattccttacataacaaaccagcaaagagtgtacattgggtttgtctaattaaggtattttgagatttatattgtctaagaattttatagatgaggaaacagaccaaatgaagtaaagtgacataaactaattggtttcctcatatagatacgtatatctttgggaaatcttaagtgtagacgtggacgttttgttcttgggttttgttttttgtattttgttttttgtttttttttttgagatggagttttgctcctgttgcccaagctggagtgcaatggcacgatcttggctcacttcaacctccgccccctgggttcaagcgattctcctgcctcagcctcccaaatagctgggattatagtcatgcgccaccaggcctggctaatttttgtatttttagtacagatggggtttcaccatgttggtcaggctggtctcgaactccttatctgtccaccttggcctcccacagtgctgggattttaggcataaaccaccatgcccagccttttcttggttcttctaatgagagtaacattttcatatgtgaaactaagaaatttttgacttgttcctaattgtgctgaacaaggcatattataatcactgaggcacaccagatttcttagtgacaaagtgaaatggctacagtatagcatagggtggtatctaacaaatttcctgttaagtaaatgttggctctttttagtaatcaatttgttttacaccccagtgttaagacttttctgttgatgttagcactacaggttttgaaaagccattttaacaatgttagatttaatgagatgatttgagccttaagtcttaaaacatacgcaaatgaaaagaaaattttcaatattttaattatgcaaacagatgattcccatagatgagggttttttaaactttttatagcagaatgctgttttctaagatgttttatggaacctcaatatataagacagaaaaataatatatcagctttagaatattaatttatgataaagtcactaaccacaaagtgagactgttagattaaaggaaaatttaatttaggggttttatgggttattgttgccattttatcagctttaatatataccttatctctgtattttgttttagtttaataacattattattttgtgtttttttttgagacggagtttcgctcttgttgcccaggctggagtgcagtggtacaactcggctcaccgcaacctccacctcccaggttcgagcgattcttctgcctcagcctcccgagtagctgggattgcaggcatgtgccgccacgcctggctaattttgtatttttagtagagacggggtttctccatgttggtcaggttggtcttgaactcctggcctgaggtgatccgcccaccttggcctcccaaagggctgggattacaggcgtgagccaccacacccggccaataagattattattaatattaataataaaaatattgagttacagagataaatatttatacataataataggtattcagtagtttatcttttagtctcaggattgtcttactgatactggggctcaaaggaggtacagaaatttttgtttcaaaatcagttaattaaaattgtataacaactactcatacttcttagttataaatgattgtcaaacaaaaagagcatccaaaactgaaaataacctttgaaactatctgtaagtcaacattatgaagacatacgaaacttcacttctcatttcacaccttactacactgatagaactgttccctgagccgttgtgttaaagtcttttgtgataactatgctgtagaagtgcatttgcttcaacaattttatttaagtcgatgtatgcaagcataagcataggttttctacagagctgctattttaaccaccattttcttttgaagaactaaataaatgcacagagaaaagcataaatgagttacttgccagcaagtatttatgttttggtgaacctcattgtgttcatatttagaaaataacatttggattgagttttttttttttttttttttttttgagacggagtttcactctcgcccacgctggattgcagtggcgcaatctcggctcactgcaacctccacctcccgggttcaagtgattctcctgcctcagcctcccgagtagctgggatcacaggtgcatgccaccacggccagctaatttttgtattttagtagagacgggttttcaccatgttgatcaggctggtctcgaactcctgaccttgtgatcctcccacctcggcctcccaaagtgctgggattacagacgtgagccaccacacccagccattttttatactttttaaaacataggcatacctcctcattttattgtggttcacagtgctttttttttttttttttaacaaatgaaagatgtggcaaccctgcatcaagcaagtctatcggcaccatttttcaaacagcacgtgctgtctctgtgtcagcattttttagcaataaaaaatggttaaggtatgtacatattttttgacgtaacactattgcgtacctactagtataaacataactttctgcatagtgtaaacataacgttcttatgtactgggagaccaaaagatttgtgtgactcactttatttctgtattcgctttattgcaatggtctggaaccaaacccacagtatctctgaggtatatctgtacttaaaatatatttgaaatttgaattcaaattttaaaatttcaaaacccctaacaatatgaaagtcttttataaaaccttccatcaacaaatgcgtttgtaggctaatgtggagtagccaacaaatttgaggtaaatttttttagttatccactggctacctttgtatcattaatcattccatttgcagatcccaagtgtccttcaagatatcactgtactcatgaagctggtgtacatagtgttgggctaacttggattcataaacttcacaaatttcttggatcaggtgagtttactaactctctgcacttttaatagatttcagaggaaaaatagatttaatagatttcagaaaagtagtttggaatagaaaaatgatagagaaaatcagtgaaaccgaaaggttctttgaaaagatcaaccacatttcacaagcctttagctagactaactataatcaagaataaaagcagggatattactattgaccttacagaaataaaagattataaaggaatattatgaacaaatgtatgccatttacataatctagatggaatggacaaattccaagaaaaaaaaaaactaccaaaactgactcaatcagggtctgggataatttgctttaaaaaaaaaaaaaaaaaaaaggccgggtgcggtggctcacgcctgtagtcgcagcactttgggaggccgaggtgggtggatcacaaaatcaggagattgagaccatcctggctaacatggtgaaaccccatctctactaaaaatacaaaaataaattctccgggcgtggtggcgggcgcctgtagtcccagctactcgggagactgaggcaggagaatggtgtgaacctgggaggcggagcttgcagtgagccaagatcacgccactgcactccagcctgggcaacagagcgagactccgtctcaaaaaaaaaaaaaaaaggctgggtgcagtggctcatgcctttaatcccagcactttgggaggccaaggcgggcggatcatgaggtcaagagattgagaccatcctggccaaccaacatggtgaaaccctgtctctacttaaaatacaaaaattagctgggtgtggtggcacacacctgtagtcccagctactcggaaggctgaggtaggagagtcgcttgaaccagggatggaggttgcagtgagccgaggtcatgccactgcactccagcccaggcgacagagcgagactctgtctcaaaaaaaaaaaaaagttaggccaggcacagtggctcacgcctgtaatcccagcactttgggaggccaaggcttgtggatcacccgaggtcaggggagtttgcgaacagtctagtcaacatggcgaaaccccgtctctactaaaaatacaaaaattagccaggcatggtggtgtgcgcctataatccctgctactctggaggctgaggcaggagaatcgcttgaacccaggaggcggagttgcagtgagccgatatcgtgccacagcactccagcctgggtgacagagcaagactccgtctcaaaacaaacaaacaaaaactgacacaaagagattgattagtaatcaaaactatccaaaaagaaaagctgaggaccacatggattcacatttaaagaattaataccggtcaggtgcagtggcctacgcctataatcccagcactttggaggccgaggcacttgaggttaggacttcaagaccaacctggtcaaaatggtgaaaccctgtctctactaaaaaaaaaaatacaaaaattagccaggcatagtggcggatgcctgtaatcccagctactcgggaggctgagacaggagaatcgcttgaacctgggaggtagagactgctgtattcgagtcgagatcacaccactgcactccagcctgggtgacagagcaagactccatctcaaaaatgaaaataaaaaataaattaaaaaaaagaattaataccaattattcacagagtgagagcagttaaaaaaaatctagcagcctttcatgttaaaaatactcaacaaacttaatagaaaggaacttcctcaaactagtgaggaaacttttcatctacaaaaaacttggaaccaacacaatgcttaatggtaaaaagactgaatccgttattggctttctactgctactgttgtaaatcatcacagacttagtggcttaaaacatgacaaatttgttatcttatagttttgtaggttagaagtcctgcatggttctcactgggcttaagttggcacagcagttttcctttctgaaagctctagggtagaatgcatttcctaccctttttcagctcctgccacattccttggcttgtagtctcttcctctatcttcaaaggcagccagcaacagtgggctgggttgagtcctcatgttgtatcactctgtttcacttttaaagaaacttgtggtaacattaagtctgcccggataatccaaggtaatgtccctatttaaaaaaaaaaaattcttttaagagacagagggtctcactctgttgtctgggtgggagtgcagtggtgcagtcattggttgctgcagtctcgaactcctgggctcaagcagtgctcctgcctcagcccccaaagtatctgggactacaggagtgagccaccatgcccagctaatttttgtgttttttgtagagatggggttttaccgtgttgcccaggctggtctcaaactcgtgggctcaaatgatccacccacctcagcctcccaaagtgctaggattacaggtgtgatccaccgcacctggccatcaaaatttaaatcttttttcttcaagaatactattacaaaagggaaaacagcccacaaaatgagagaaaatatttgtgtgataatggactcgtatggagaacaatataaagaacccttagcatttgatacagttgggcaaatagcatatatataaaaagatgtacaacattattagtcattatggaaataagataccacaaaaccacaatgaggtatcacgtcatatccactagtatagctaaaatgaaaaagatggacattaacaagtgttgaggatgtgggaaaaaatggggacttttatacagtgcttatagaaatgtaaaatggtacagtctttggaaaacaatctggcagttcctcaaatgattattcatagagttaccatgtacctgatagtccagtcctgagtatatttccaagagaaatgaagacctgtatccacacaaatactggtacatgagtgttcacagcagcattattcatcatagcccagaagccacatacccaagtgtccataagctgatgaatggatagataaaatgtggtgtgtctatacaacagagtattattcaacaatgaaaaggaatgaagtactgatacatgctccaatatggatgaactgtgaacagatgctaagtgaaagaagccagttacaaacaactgtatggctgtttatatgagatgtccagaatagacaaatgtacagagacagaaagtagattagttgcctaggtctgggaagtttggtagaaactgaggagtgattgctaatggttatgtgggtttcttttggggaaatgaaaatattccaaattgttaatgataggtatacaattttttttttagacggagtttcactcttgttgcccaggctggggtgcaatggcatgatcttggctcaccacaacctccacctcctgggttcaagcgattcacctgcctcagcctctcgagtagctgggattacaggtgcccaccaccacgtccagctaatttttgtgtttttagtagagacggcgtctcgctatgttggccaggctggtcttgaactcctgacctcgggtgatccacccaccttggcctccgaaagtgctgggaattacaggcatgagccaccgcaccctgccaggtatacaattcttacactaaaaacttactgaattgtatactttaatgggtatactttaaatggatgacttgtatggtactgtgaattacgtttcaaaaagctgttacaggccaggcgtggtggttcacacctgtaatcccagcactttgggaggctgaggcaggtagatcacctgagttcaggagttcgagaccagtctggccaataccgtgaaaccctgtctactactaaaacctgggcgtggtggcgtccacctgtagtcccagctactcaggaggctgacgcaggagaatcacttaaacccagaagccggaggttgcattgagcagagattgggccactgcgctccagcctgggcaacagagggagactccatccaaaaaaaaataaagctgttataaattgagtatccctactctgaaaaatttgaaatccaaaacttttcttttttccatccttgaacctgagtgagctacaaaagtttttgagtgctgtcatgacaacagaaatgctcattggagcatttaggattttagattttcagataagagatgttcaactactaagtataatgcacatattccaaaatccaaaaaaaaaatgtgaaatccaaaacacttctgatcccaagcattttggataaaggatactcaacctttatgaaaataaaatcagtgtgggtaagcagcaccctagaagagaatgatttcactgttcttagtgaaacatttttgcattcagagacattacgaaggaaaatcctacttcttggggcggaaatctagaccccctgggaaagcgtatgcctatgtcagaaaagcatagtacttgagaagcaatgttttcagacaagaacctcactgcatttaacccaatatcattagcattttaatttggagacttgtctaagcatcatttcatttatgtaatgtcttccatggtagatgaagaagataaggatagtttacaggaactctctacagaacagaaatgctttgttgaacacatcctttgtacgaagccattgccctgcaggtaaggactctccctcccttgtatatcagaaaacaattgttcatttcagcagttcagatacgtttgtatccgttacactcacatccacagtattcactgctgagtcatttgaaagttgcagacgtgatacttctcccctaagagtgtcctgctcatcagaagctttctcctctccagggccactcgacatactgtttcctgactggaaggtccttccccagccccagccccagccccagcttgctgtcttctcttggctaactcctacccttctttctgatcttaatgtcacttcttcacagagaacacccttgactccccagtctaacttggggctctcctattctcttatccattgtagcacatattacactatttatatttgcatttttttaatgtctgtcgccactaccggaatgtatatgtttcatgagagcagagactgtgtctgcccttcactgcattgctgtgtttatttgatgtggttgcccatgtctcctctttgaaacacattctccttggcatccttgacgtctgtccctccaggttctccttcagtcccgccagcagcccttttctcaagtttccttcttgggcgggttcctctgcctctactcactgcttataagtaatgctcacaactctttccttgggtcttctctattctttctaggtcctttcctgagtaacttctgccgtaatcatggcttcagtgctgacagttcccgcatccatatcgccctagcccagaccactctgaactccagattcacatacccagctgcctactgggctcctccacttggatatcctataggaacataaaactccagatgtccccttaactcatcttctgtctttccaaatctgctctctctcctgtgtcccatttttctgaagggtgccatatcaccccagttatccccagtagaaacctggaaggtattctagatacctccctttattctgttcatcaattactagatatctcataagcactctgttagacatggagtatacacagacatgagacaaatagcatacactaagaaatagacataatctaggtttggcaatacagaggaccacagggaaaacgcttggtggggaatgagaaggatagcaaactgtaccagcttgaaaagtgaacagtgaaaccaggcactgtggcttacgcctataatcccagcattttgggagatcgaggtgggtggatcacacggtcaggagtgcaagaccagcctggccaagatggtgaaaccccatctctgctaaaaactacaaaaattagccaggcatggtggcagacacctgcaatcccagctactcgggaggctgaggcaggagaattgcttgaacccgggcagcacaggttgcagtgagctgagatcatgccactgcactccagtctgggtgacagagtgagactccatctcaaaaaaaaaaaaaaaaaaagaaaagtgaacaaggaaaatacataataaaatcccatgtaggctgggcatggtggcttacacctataatcccagcactttgtcaggtgaggcaggaggatcacttgaggccaggagtttgagaccagcctgggcaacatagtgagaccctttacaaaaaaatttaaaaattagctaggtgaggccaggcgtggtggctcacgcctgtaatcccagcactttgggaggctgaggcaggcgaattactaggtcaggagttcgagaccagcctggccaacgtggtgaaaccccgtctctactaaaatacaaaaaaaaaattagctgggtgtagtggcgggcacctgtaatcccagctactcaggaggctgaggcaggagaatcgtatgaccctgggaggtggaggctgcagtgagccaagatcatgtcactgcactccagcctgggcaacagagtgagactccgtctcaaacaaaaaaaaaaattagccactgtggtagcatgtacctgtggtcccagctactcaggaggctgagaaggaaggattgtttgagcccacgaggtcaaggctgcagtgagtcgtgatcgcactattgcactccagcctcggcaacagagtgagaccctatctcaaaaaaaccccaaaatcccatttatatcaatttcagaaacaggtaaaattaaacagtcttgcctaggagtgaatacatagataggaaaactataaagcaaagcaaagacatgatattatgaatgtcagagtagcggctacttctctggggagtgaaaggctatgaccagggaaggtcgcatgggaaccctgaggccccctgcagtgtcctgattcttgacctggatactggttacatagtgtatagcccagtagtgtgtagatttcacactgataataaaaagttaaagtttacaaccttccagatatcgtctccatgtcttgtccaaaaaggtaaatgggagctatggaaggggaactagtgttttcaactgctgtttaaagactgctggttctaaagggatggcgagaaagaataggttaaggggaactggacattatattgaaatgagagtattttaaatggaagagacatgagtttgcaagctgaggggaagtagataatagggagattttgaaacgacacagttgatggtacaattttcagaaggtgtgagaggaggcggcatccacattcgggggcagatgtgtgttgtaggcatgcaggtgggatgggcatgggagccgctaggagagcatgttggcagaatgacagttcccatctgaggtctcagtttccagtgtcttcactgaagtgggaaggaagactgagagagatacacgctgtgcgtgccaagtgatttcctgtgacattgacattgggcctcattgagagagactcggtagttctgttcattcaacagtttctaagcacttaatttgttagcactgggctaggcaaacaaagatagctggggcttatgtgcaagttggagagatcttcagtgtaacgtgtaacttttgagattacagtcagcagcacgctacagttagggattcctgagtgacttagtcacatgggctctagactttagtgtggagctgcattaaaggtttccaagccaccacttttgaggttatggtactgataggatgtcccaagcaacttcagcccaggcctgagaaggccgcggacctgtcatgtctttgctcttggttccattgcatttgctgctttgtaatttaactatgactgtgtttttccaggcagccagctccaattcgaggattttggattgtacctgacattctgggacccacgatgatctgcatcaccagtacctatgaatgcctcatatggccgttattgtacgtcccattttatattctccacacagctcttgttaattctgcaatatctaagttgggaaaatgcactcagtaaccaacttgaagctatacatgtgtggtttatactttggcttctgacttgagggttggaaggatggatatttctgttcctgccatcatctctataaggtttcattgtaggtatagtttctggcatcccctgcacctagctgagagtcaggagcttttcttcagagtgtggagaaaaaatactaaaattgaataccaaattccattatcgatatgagtaataattatcaagctgtgaccatacgccaagctcagaagtaagccacgtacccgcactgcctcctggaatcatcagggcagccctgtaaggaaggcactgtcatttccattttataaaagtggaaacggggatcgagaggttagtaaatgctgaagtcacaggtaacaaatagagctgggatacagatgcaggtctcattgactcagaagtccatactcatactctttaatttctccatctctgccagcctgagggacactgtagactatgtaaactggaataaagctgaactcaggctgggtgcagtggtggttcatgcctgtaatcccaatgctttgggaggcccagagttcgagatcagcctgggcaaaacagtgagacccccatctctacaaaaaacaaaaaaattagccaggcatggtggtacacatctgtagtcctagctgctcaggtgagaggattgcttaagcccaggagttttaggctgcagtgaaccatgatcatgccactgcactacagcctgggtaacagagcaagaccctgtgtcttttaaaaaaaaaaacaaaaaagctgaactcttagtctttgctcctttaaggaactcagataattaagctgtaatcactatgttccttttccaacagccctggaagatcattctgagttacataaatgtaggaatatgagtaccaaaaacaaaagtcactggagcttcaaacactagacaacacccccaccccttgtccgttcaaagcttgcacctctggatgctgacataaattcctaatactggcagtagtttactgtccttagaggatcttccatagtctttgaagcttgattaagttgtactatctggatgtaaaaataaatataaattttgtgttatttacactgaaggcactaaaagctagcaagaccaaacaaaaataataaaatcactggagaaaaaattacctgtaagttacctcagcatactttttaaacacccacagtacatttagtaaaataaaacctagtcacactagcttacttcagaataaatatgaatcccaaaggggaaaaataaacattaattgtctggatattttttttttttttttttgagacggagtttgctgtgttgcccaagctggagggcagtggcacgatctcagctcactgcaacctctgcctcccgggttcaagtgattctcctgcctcagcctccctagtagctgggattacaggcgcacaccacatgcccagctaatttttatatttttagtagagatgaggttttgccatgttggccaggctggtcctgaactcctgacctcaggtgatccacccacctcggcctcccaaagtgctgggattacaggcatgagccaccgtgccaggccaattatctggatactttcagatcatatttctgccaactccctgaaatacaagttgtctataaagttatgctatttcatgaactttcacttttttttttttttttttttgagacagagtcttgctctgtcacccaggctggagtgcagtggtgtgatctcagctcactgcaacctccgcctcctgggttcaggcgattctcatgcctcagccacccaagtagctgggattacagatgtgtgccaccacacccagctgatttttatatttttagtagagacagttttaccacgttggccaggcttgtcttgaacgcctgacctcaagtgatccacctgcctcggcctcccaaagtgctgggattacaggcgtgagccaccacgcccaaccaaacattcacgttagaattgttgccttcagagtaagtcacttgccatgctgccgaagtctgtgagatcttttaagctctttttgaagtttgagtatttgcacttgactgaatagtttttagaaatgaaattatatagaaccaatatggtatatacagcagtttcttggcttaatattggttttgatcaactctaaacctaacaaataagtaatttatgtttgtggctccggcttataaactggctttcaagtcctttgccaagaatccatgctaggtgtttgtgctgccttgatcttttagaaaagaactggaaatggcagtcagaaatgctttcacaaatcaggggcattggaataataagggtgtagcttcccaaagtgaccttttcaaggtggaaaacatgcattcttgcacttttacaaaagttacactttattttatattctgaaagttctggattaatgtggtttctgctttcctgtaatacagtaaatcactccatggtagaattcaatttacttacttattttgcagaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaagtatgcaaccttgggcatagcggttttatgaatgggttctcttctgtcttcagaattactgtgcatcctttctgtcctcatctgtttcatatactttttactgtgataaatttggaagaaactggatatatttgatcagctagtgaatggggagcaggagggaagtggcacctgagaatgataaacaggaagtgtttaaaaagaagttaggctaggccgggcgtggtggctcacacctgtaatctcagcactttgggagaccaagacgggtgaatcgcgaggtcaggagatcgagaccatcctggctaacacagcaaaaccccatctctactaaaaatacaaaaaaaaattagctgggtgtggtggcagatgcctgtaatcccagctacttgggaggctgaggcaggagaaccgcttgaacctgggaggcagaggttgcagtgagctgagatcccaccactgcactccagcctgggcgacagtgagactcgtctcaagttaggctgggcacggtggcttacagctgtaatcccagcactttgggaggcccaggcaggcggatcacctaaggtcaggagttcaaaaccagcccggccaacatggtgaaaccctgtctctactaaaaatgcaataattagccaggcgtggtggtgggcacctgtaatcccagctactcgagaggctgaggcagaagaattgctcgaacctgggaggtggaggttgcagtgagccgagatagcaccaatgcactccagcctgggtgacagagcgagactgcatctcaaataaataaattaaaaatataaaaagtttaaaaagcacctgtgacttgagtctatttattttcagttgttttactcagctaaggaaaataaaggtagaaactttgtttttaagagcttctgaaaaggacatagcccctcctcctgaagaatgccttcagctcctcagcagagccacccaggtgttcagagagcagtacattctcaaacaggacttggcaaaggaggagattcagcggaggtatgatgtcctgtgttcacaaaccatcgatccctggctggtagctgatgctgtatggtagcctagacctggcttctgaataaactctatttctttttgtttttaaagggtcaaattattatgtgaccaaaaaaagaaacaactagaagatctcagttattgtcgagaagagaggtaagtgtcaaaaataagaagaatacaataggtcagtaagactggaaccatattctcaccctaagatgctgagccacattaggtggtttcagcatcaaggggtggacctcaagagtctcttgtgtcttacatcattaggaaaagtctgcgggaaatggctgagcgtttagctgacaaatatgaggaagctaaagaaaaacaagaggatatcatgaacaggtcagtgggctgtataacatttagttacctagtcaggtactaacaacgatatttaagaaaatgggcattggcaggtgcttacatacctacggaactgaactgatccccctgcctctcctctgaagtatatgttggggaaaacatgaggctctcccctaacccttcctatggggcctacttcagaaacaccagattcatgaattatgagcttgtgattatgtttctcctaattagtagagaccttaaattgagatgtttgcttgccttttctaaaggatgaaaaaactacttcacagttttcactctgagctcccagttctctctgatagtgagcgagacatgaagaaagaattacagctgatacctgatcaacttcgacatttgggcaatgccatcaaacaggtaggaatagatccaaactagctaaatttggtaatttttcttaaagcacttattctacagaaaattttacaaaaatgtaaaaagaacagattcaaatagatactgtgaaaatgtgtggcaaaccactgccaaaatatctattattttaatacttaaggttactatgaaaaaggattatcaacagcaaaagatggagaaggtgttgagtcttccaaaacccaccattattctcagtgcctaccagcgaaagtgcattcagtccatcctgaaagaggagtaagtaaatacttccaatcagctattatcgtgagatagtttttcctttacagtatgccagaatcaacctgtcttaatagaaacctgaatcttggtatttgcatgtcaagtaattactgggatgagagccacatgatacatagggacttaagaaatgactatggtgggaggattgaaagggatgaccttctagtaacatgattttgttgtgtggccaaaggtattttacagtaattatgttcaaaaatatttccagtacttgcaccgtttgccaccttaaatgaatagtgaacactattgctatccacctgaaaccttcagctgttaattttagcaaagcagttcttagatgtttcaacattaccagtttaaattcttaagaatccatataaatggtttattataattccaaaagtgagtgactttacaattttacaggggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagctcaagatccacaattgcaaaggccactgctggctcacttcctcacaagctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtactactatatctgcttagaaatggctgagtgactgtcaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataaccatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccgctgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatccgctctaactgcacctggagaaacaatggtgagataactacaggtggctcctgcctagattttctgaactttgactggtttagctgagatgtagcagattaactcaccagagtactagtcacttcaaagggagacagcaagaacaattaaaaattttaaaaataattccccaaagctaccgtgtaacggactgggatttttttttgggggggagagttttgctcatcatccaggccagcccaggccagagtgcaatggtgtgatctcggctcactgtagtctccacctcccgggttcaagtgattctcctgtctcagcctcccgagtagctgagattacaggtgcctgccatcacacctggcttgcttgctttttcttttcctccagatggagtattgctccgtcacccaggctggagtgcagtggcatgatcttggctcactgcaacctccacttcccgggttcaagcaattctcctgtctcagcctcccaagtagctgggattataagcacacgccaccatgcccggctaatttttgtattttaagtagagacggggtttcaccatattgttggtcaatctggtctcaaactcctgacctcaggtaatccatccatgtcagcctcccatactgctgggattataggcgtgagccaccatgcctggcccagactaggattttaaagtgtaatgtgttgggattatggagacaaatgagacctgactcccaatcctgaagaatccacagttccagtccgggcacggtggctcacgcctgtaatcccagcaatttgggaggctgaggcaggtggatcacctgaggtcaggagtttgagaccagcctgaccaacatggtgaaaccctgtctctactaaaaatacaaaaattagctgggcttggtggtgtgtacttgtaatcccagctacccaggaggatgaggcaggagaatcgctggaatccaggaggcacaggctgcagtgagccaagatcacaccactgcactctagcctgggcaacagagcatgactccgtctccaaaaaaaaaaaaaaatccgaagttccattgggaaaaaaacttagttttagcacaatattctaaatgtcattgtgtcattacaggcattcatagagtgcccgagggagcatggcagagggaggggcactttagcccagctcagggacctagaagagctccacagaggggacagacctacgctgagccttgaaagaaaggagtcaggaggggatgagatgaggatgcttaccagacagaacaccacgctgtgggcgaggaaccacaagcagttaaacatgtaaaacaaggcagagagatgagcaaaatacaggggtgggcctggttgggaagagtcttacatggtatgctaaggagtcagtactttactcataaggaggcaaaattggcaaggcatacagaaaaagaaaaatgggccaagtgtgaagaacacaccaggtttctggcttgaatgatgagtcagacatttggggtggaggtaggagcagccagtctctaaacctctagctactgccagtggtcaagtcagggatcggcaaggttctgtcccccaaaactgccttcgtgctctgtatgtggttccccaaatgcctcacctgaagggtctgtgaaagctttacaaaatccctctggacttgctcactgacatctaattctgtctgtaatctctgagctttattcttctcttcaaacattagttgttcaacggtagcctaaaaaatacaagttttgaatgaagattaatgccaaagggccgaattacttaggaaatccagtaacttgtagttacctactactagggcagaaaggtgggtggatatccgtcgcactcctatacacgaccaatctctttatctatagggcaagcgtgcaggccatctagactacttgctctaagtcctgagatgaactgggtatgaaaagccaaaggaagaaatggattaaagtgctgccctcccccacccccagcagctggtgacagtgacgataatcaccaaaacagctgctaagatcggtgtctgtcacaccaacagggatacatacaggacttcctctgacaacctccacagtcaagcatccaccaggaaacttagtgaatacgccccagctatccccagtctctcttacagaaaaccagcaggatgtgtgggagcctttccaaaaacaagcagttcagcaacactgtctgcactttcaggtctgaccactcagctcactaagaccatttctaggaaactacccccacaacatgcacgtttattctaacggaactcatcaaaatttaggcagcaaacctggtttgatgcaatctctcttaggatttgatacatcagtcaaatggaatgacattttcaaagcagtgcttctaactgggcagtgcccaggcttggtcaatggccctgactgcctactatctgaagctagcctatgacgcaggcctccagacctggcagaaaagatttaacccagctggaatagatcaattcgtttaagttttttcttttcacaagctgtcagttttgccaactttttaaaaggtgacacttcaaagcaccaatatttttttttcaacaagcaagatgtgatcctgcattcttagccctgctttttaaaattaaatgactaatgaaaacactaccttagcagcagtctctttctttaactgctcttccaaactgatctttatttcctgaagactctcaagctgttgagacttctctcttaatgtggactccaactgtgaaaaaggaaaaagctgaaactcacagaaactccctctgggccccagtgcactacctaaaagagcctagagcctggagaattacaccaagacactcgggctacactgggaatactcctctcaccctttcagctctgtggatcccctctgtattcttcctgaactattctttcattaaccattattaggtgcctactatattctaaggcctcaaaatggagaaatcagggtaaacagacatgtaaaggatgaagaaagaagcatttaattctgccagaaaagttacaaaggacttcctagaggagatgacatttgactcctacatttttacagggcaaagacaagggtgacaaggggagaagatggagagatactccaataagagggaatggatggcacgcactaaaaacacatgcagcaacagtggcatgttcggctggcctacagcacagcacgttgggagccacaggcactgaggcagagaggtgtgaggcaggagagctctggctgggctaaggatatggacttgatcctgtaaaataaagggaactacgggagggctttccactagactgggacgcgaacaagtttctaatgtttaaatatcaccttgatttcaatatggagatgatttagggacaaattttggaggcagggaaagttaggctgttacaataagccaggtgagagtgaagtctgaactcaaagagtggcagctagaatggaaaggatgagatgttatttcgagcgctggtaatttctgctggtgcaatatcagtagcaaagtggaggcaggaggcagactgcagcaggtggagggatgcctgggaagtcaggcagtgatgatgatcaagactgtggcaacagagggaggaagaaagagtggtagctcgggagaggagtgcaatccaaagacagactttttccttctgaatatgagacacctgagcctgttcatgcataatggaaaagatcagtcaagaggcagaagttcaaggcccggcactgcgcggggacatctggaaaagtcggagatactcagtcaaagcacctatgcaatgacactgtggtcagaagcaggtcatgatattctctgaagaaaaagaaaagactgggaataaaaggaaaacctgtaattgaggagcccagtagctgaaggtggccctgcctgatgcctgaggagtgaggccagcatctgctgagagtgagggggctgaggtgaggtgactctgaaactgccactgtgaggaatggaagagacgcaacttaggacacatgaaaggctgcatgaggaacactggaggcccatctggcagcttgagcatgcagtgtcaccaagtctcgtggcatcagcagctggggacagcaagactagtccaaggttgggcagtggtcaggtgagggcagcagcaggacaaggagtcaaagaccatagggacaggtgtggtgggagatgaagggaagaggcaggccagtaagatgcaacctaggggaaagaaagcaagccatgaagctgctgaaaccagaatgaaaggggaagttcagagaactggaggtctgaatgaggtactccgatggaagagctggaaggatggcagattgtggtcaaggaacttaaggctgcagtgagatgtcacagttgggcaaaatgcagcccagtgtgtggaaggggagagcagggtggaggtgaaaatctctaaatcaaggaacagtgaggtcaggaagttgaatggggttactatgaaaggaactaatgatgtctaagaggactaagccagctagaaaatgtcatctcttgtttgtaatgttttttatacatatttctactgtacctctaagcatataacatgttatgaccatgccttgcctatcttctcactacactggaaactccaggccacagtcacatcttagccttacctcctccagtttaacgtagcctgacacacagggcactctcaataaatcaccagcacacccttaccccgtggttttcttcccacaagacaaaagttccttaaggcagggcccatgccttaactattttttattcgttgggtgcagcatagtaggagtcagtaaataaccactggttgctgatagaattaatttgaaactcacgacttacctgtcctttttccacttttattctttctaattcagcttttaggctagaaatagaagctagaaggaaaaaaatgagatgtattagcattcatctattattgtgcatgaacatttttttctttaaaattttagagcaccccccaaaggattcaaatgtatgctgaacatgggttccgggggctgtctcaaaattaccaccaagcaatcagcatatttaggctcagggaaaagcaggatccatgcaaatggacactgtgtcataaactacctctagatcatgtatcacatctctgcagggaaatgccacccattgaatcacgttcccctggttctgggttcaagtactgagaatcctatctatgaataattgccaaagaggccacagaactcctaaaaagacgagttttcggccaggcgcgttggcttacaactgtaatcccagcatttgcaaggccgaggcaggcagatcacctgaggtcaggagttcgagaccagcttgaccaacatggagaaacccgtctctactaaaaatacaaaattagctgggtgtgctggcacacatgcctgtaatcccagctactcgggaggctgaggcagcagaattgcctgaacctgggaggcagaggttgcggtgagccaagatcgcgccattgcactccagcctgggcaacaagaatgaaactccgtctcaaaaaaaaaaaaaaaaaaaaaaattttttaaataaccagaatttctgattatttgactatatcagaatatatattcagaatctgaatatatcagaatatctacaaaaaatggactgagtccttactaaattctttcctaagcttttctgtgttccagactccatggccatgtattgcttcttttactaaagttttatttagtgactctaattctaaactacatcacttttatcttcacctatttcctccttgcagttttctatttctagttgcagagtttcttcaagattttcttttaaacactgttctgcttggatctgctcttttaggaaaagtatctcagccttcagcttttcttctacgtggtctgctgctgtccgcacattaatgatgtcctcacggtattttaataccaactcccgcagtgcctggattcaagaaacaaatgattattgggtttgtgagagtgaaaggaaataaagaagctaaagattttctgtaaccagaatctcagatgttgttttaatggttcaaaaattaagactttgaccattaagccacttagagcttcagggcaggtgccatgtcaggttaacattcagtatgttatagaaaagacatttctggccaagtcgtatcttgtaagccacatactcttccctcaaaactgtttcataagcagaaaaataaaaagattaagtgacttacaatatgccattcaatagaaataataccttagaatcctctactattacttgcagaaatttgggaggagttaggaaatgaagacaaaactgagtagcaagttcacactcagtagcaagtgtgaactaagaggataacatttatttacttactcacttattcattcattcaaacatttactaaacatctaccagaggcaaagtactaccttaggccagaggtaaataatggcaaaggtggctttctaaggtggtaagctgtttttctgtaataaattcagtatagaatttatttttcttcctaaattttagttctgtcttcttttagaaatccttccaattatatcctaaagcaactctaaagtaaaaacgagattctcaaataacaatatatataaaacaacagtttttaaaatttcctaagatttattgctgaagcaggtccaagaatcaaggattacacactgactacattcttcaaggattcttggaactttttttttctttttcttgagacaggatcttcctctgtcacccagactggagtatggagtgcaatggcataatcatatctcaccacagactcaaactcctgggctcaagcaaaactcccacttcaacctcccaatgtgctgggattacaggcaagtgccactgtgcccggcctggattcttggaacattttaagatctaggactaggcaggcgcggtggctaaagcctgtaatcccagcacttttgggaagccgaggaaggcggattccttgaggtcgagaattcgagaccagcctggccaacatggtagccagacatggtggcacacacctgtagtcccagctactcaggaggcagaggcaggagaattgcttgaacccagaaggcggaggttgcaataagctgagattacaccactgcactccagcctgggtgacagagcaagactctgtctcaaaataaataaataaataaataaataaaatgaaataaaatctaggaataaagtctctaaagaacatggaagacaggattctttcctgacaaaagagaaaaatctaacaggtggaaggtggtaaacagtgattttaagctgatagcaaaagtagacaggttcccaaaacctttttttttttaattgagacagggtcctcactctgtctcccaggctggagggcagtggcgcgatctcagctcactgcagctttgacctcctgggctcaggcgacccctcccacctcagcctcccaagtagttgtagctgggactactacaagtgtgtgccaccatccttggctaattttttttgtttgtttcagtagcatcggggttttgccatgttgtccaggctggtgttgaactcctgacctcaagcaatctgcctgccttggcctcccaaagtgctaggattgcaggcctcagccaccataccctgcccccgataccttcttttgatgacagcagtcaccaattcagaaaggaaagaaggctctgccaagagtgcctgtaacatgagctgagacgataagaagttggggaaaggtgggagacagcaaagagctaatggcaagataggcaactggttttttgtaaatgatgaaataaacataaaaaataacagtcatgttaatacatatataggaaaaaagaatgaggtccaaattatagagattgaatctgtagggtataattaggggaaacttctacttactaagatttccttaaaaaggaaaaaaaaaaaaaaaaagaaacaggtataaagattggataggacaggcacggtgtctcatgcctgcaatcccagcactttgggaggccgaagcaggctaatcacctgagatcaggagttcgagaccagcctggccaacatggcgaaaccgcatctctactaaaaatacaaaaaaaggccaggtgcggtggctgatgcctgtaatccccgcactttgggaggccaaggcgggcggatcacgaggtcaggagttggagaccagcctagccaatgtggtgaaaccccatctctactaaaaaatattttaaaaaatttgccaggcacagtggcacgcgcctgttgtcccagtactcaggaagctgaggcaggagaatcacttgaacctgggagacagaggttgcagtaagcctaggttgcgccactgcactccagcctgggtgacagagcaagactccatctcaaaaaataaaaataaaataaaaaataataaaaaaaataaaaatacagaaacaaattagcccagcgtgctggcgcacgcctgtaatcccagctactcgggaggctgaggcaggagaatcacttgaacccaggaggcggaggttgcagtgagccaagatcacaccactgcactccagcctaggggacagaatgaaactgtgtctcaaaaaataaaaattaaaaattaagcttggataaagttaaggagagaattatgaatgtctctgggaaaccagttttgtagcccaggtttacccaaccacagaagaatgtaagtgaccaaaagtgccatctttggctgggcatggtggctcacgtgaggtcaggagctcaagaccagcctggcaaacatggtgaaaccccatctatactataaatgcaaaaaattagctgggcatggtggcaggcgcttgtaatcccagctactggggaggctgaggcaggagaatcgtttaaacctgtgaggcggaggttgcagtgagcagagatgatgccattgcactccagcctgggtgacagatattatctgtctcaaaaagaaacaaaagtgtcatctttatggacagcatgatggtgagtgtgttataacttttcaagtactagatacaaaaacaaacgtcataagcagccagcatggtaaccccttcaaacatttaatttctggcacactctcaatctgggccgacaaaaataacatagatcttcaaaacattaaggctacgtgaaagaacatggacacaaaagaccacatatcgtatgattctattcataggaaagtccagaatagggaaatctatagaggcagaaaggttagtagttgcttaaggctaggggaggagggggaataaggatggtagctaaagggcgaagtgttactttttcgtgtgtgtgtgtgtgtgtgtgtgtgtgtgtgtgtgtgtgtgtgtgtgtttagctggtgtagtcgggtcacagggagttactacttgaggtgatgaaaatgttgtaaaattgattgtgatgatggttgcacacatctgtgagtacagcaaaaaccactgaatggtacattttaaatggttgaattggcacgtgaattatatctgaataaaactgtttacataaagaacatacggccatttcagaaaacgtacttgttgacatttttgatcatgtggaaagtaagttacctctgtagtgtctgggaggatgaagtcttctgcttgctgtaatgacacatgcaggctgtgctttccctggagactgtcattatctttctgtaacctcaccagctcttctgaaacctgttcccgtgactgcatcagcaccgcc

SEQ ID NO: 14780 - DNA, 979 bp, Homo sapiens
gagaggggtacctagaacccagagaacattggcttatgccagataccacaccacatctgggcttacattcttgtatcttttttggtgtgtgggcggggggggtggggggcagttcagtgaagtctagaagacctgctggacaaattctaaaagagctagagctgtaacacttattcttgcatcttattaattttctatgatattttttccttcttcgtagggacttgggacaatctggctttgctgctttctaactgctaggcacctctctctaaccctcattgtcagagggaattggaggatatccacagtctgttcctgttctgatattctgagcagagaaaaggcactaacggttcctcttagctatttaattatcagaagcaagtaatctttccccagataatattttgccctagaagaagccgtgatttagctcttttattgtgcttacttggtccaaatacatctgtggggtgttttgtcatttcttaatgaatgaatcatagttataaccaggggccaagctgcccaagaggctcttcagagatcatggatgctctctttctggaagctgtggcctgatggagcagccccattccagggtcccatctgtccggagttgtgtatgtcaagtccggctcagtctttatttccaacactagccgtggtcctgtgcagtcaagctctcagctagtgtttagggctgtctgtcagaaatggttatacgtgggcaaaagaagatctgacagctcctatataccttatcttactgaattcttaaactttgaaccagttcttccacttactgacttgttaccactgctgactttctgaaaagttttccagtttttgttttttgttttttgttttccagtaggggattagaatgtttagtcctacttagtaagaaaaatattgtatttttaatcattcatagtgctggtaaaaaaaaaaaaaaaaaaaaaaaaattggggg

SEQ ID NO: 14781 - DNA, 91 bp, Homo sapiens; identical to SEQ ID NO: 11440

SEQ ID NO: 14782 - DNA, 1429 bp, Homo sapiens
cagtacctaaaatagtggctggcccctatgtattgggtcatagcaggtactacattcacctctctactatgtttaatacagtttatttcccttgtgtgtgccttgctaaaatatttatgtttaaatttctgtatttgatacacattgtgaaaggacattttcaagtctaagtcccatgacttgagtttgcctgtgtctcccattaaaagctctcaattacaccattgtgtgcccagtacctcgcattgtgcctggccagtgttggacagtaaataaaaattcagtgtcttattcactgaggtatagtgcctaaaacagaagacattccataaatatgtgtggaatgaatgacttaaatatttgattaatgaagtttaagttgagcaaagaaaggagaactagtagcttagatttactaagaatactatgccacatttatttgtttatttttagagacagtcttactctgttgcccatgctggagtacagttgtatgatcatagctcactatggactcaacctcctgggctcaagcaatcctcccatctcagcctcccaagtagctgggactacaggaatgcaccctcttccctggctaatttttaaatttcctgtagagatggggtcttgctatgttgcccaggctgtcctcaaactcctggcctgaagtaatcctcccatctcagcctcccaaagtgctgggagtacagatgtgagccaccgctcgtggcctatgctacatttattttaacatctttatcgttcacaagtaatttcacaggtatccccttacttgagtcttgcaacaactctatgaggtttattttgccagatttatagctgaggaataagactcagaggagtcagagggcttctctaagattatttagcttgcagattggaacttgaacccaagccttgactcctaattttatatttgtatgaattcatacaaatgtcataggaaattatccacattttataactagaattatagaattagaagtggcctcacacatcacaaatcctgaacccctcactcatttttcaaaagaggaaaataagaattggaaagtttatatatgtatccaaaggtacacatccagtttaggaatttcaaaaagctggctaggcacagtggcacatacctgtaattccagcagtttgggagcccgaggtgggtggatcacctgaggtcaggagttcgagaccagcctgaccaacatggcgaaaccccatctctactaaaaatacaaaactagccaggtgtggtggtgcacacctgtaagtaatcccagctacttgggaggcggaggcaggagaatagcttgaacctgggaggcggagattgcagtgagctgagattgcaccactgcactccagcctggacgacagagggagactccgtctcaaaaaaaaaaaaaaaaaa

SEQ ID NO: 14783 - DNA, 1444 bp, Homo sapiens
cagtacctaaaatagtggctggcccctatgtattgggtcatagcaggtactacattcacctctctactatgtttaatacagtttatttcccttgtgtgtgccttgctaaaatatttatgtttaaatttctgtatttgatacacattgtgaaaggacattttcaagtctaagtcccatgacttgagtttgcctgtgtctcccattaaaagctctcaattacaccattgtgtgcccagtacctcgcattgtgcctggccagtgttggacagtaaataaaaattcagtgtcttattcactgaggtatagtgcctaaaacagaagacattccataaatatgtgtggaatgaatgacttaaatatttgattaatgaagtttaagttgagcaaagaaaggagaactagtagcttagatttactaagaatactatgccacatttatttgtttatttttagagacagtcttactctgttgcccatgctggagtacagttgtatgatcatagctcactatggactcaacctcctgggctcaagcaatcctcccatctcagcctcccaagtagctgggactacaggaatgcaccctcttccctggctaatttttaaatttcctgtagagatggggtcttgctatgttgcccaggctgtcctcaaactcctggcctgaagtaatcctcccatctcagcctcccaaagtgctgggagtacagatgtgagccaccgctcgtggcctatgctacatttattttaacatctttatcgttcacaagtaatttcacaggtatccccttacttgagtcttgcaacaactctatgaggtttattttgccagatttatagctgaggaataagactcagaggagtcagagggcttctctaagattatttagcttgcagattggaacttgaacccaagccttgactcctaattttatatttgtatgaattcatacaaatgtcataggaaattatccacattttataactagaattatagaattagaagtggcctcacacatcacaaatcctgaacccctcactcatttttcaaaagaggaaaataagaattggaaagtttatatatgtatccaaaggtacacatccagtttaggaatttcaaaaagctggctaggcacagtggcacatacctgtaattccagcagtttgggagcccgaggtgggtggatcacctgaggtcaggagttcgagaccagcctgaccaacatggcgaaaccccatctctactaaaaatacaaaactagccaggtgtggtggtgcacacctgtaagtaatcccagctacttgggaggcggaggcaggagaatagcttgaacctgggaggcggagattgcagtgagctgagattgcaccactgcactccagcctggacgacagagggagactccgtctcaaaaaaaaaaaaaaaaaaaaaaaaaaaaaaaaa

SEQ ID NO: 14784 - DNA, 200 bp, Homo sapiens
tactaaagaatctgcagttgttggatacactgctgaatgcatatgtgagcaatagttagaggttagatggaggctagtgatccattattggctgcaggagtcctcgtgctgtgtgagacacagatagattcaaaggaccctagaaaagggtagagctcaatcatacatttgcagaatatatgaatggtgtttgaaaatct

SEQ ID NO: 14785 - DNA, 532 bp, Homo sapiens
aatgaaaattcagttgaaactacgtgtctgccttaccaaattcttcctcagggtcttagactaccaagtccttcatgaagctttcctggcaagtgagagaatgtatgtaaaatgtcttgcagtgtggccagcacaaaacagtctcacaagagctgcatctttctctcctgcggttactctagccagaagtgatgtctttctccttgtagctcctatatgtcatttaatcaaatggcatcaactcatactgtctaatactagagtttgcatttctcttaagttttcaatgtgaatgtaaatgccaggtagcaaggaccttgcacagtgcatcatactaaagaatctgcagttgttggatacactgctgaatgcatatgtgagcaatagttagaggttagatggaggctagtgatccattattggctgcaggagtcctcgtgctgtgtgagacacagatagattcaaaggaccctagaaaagggtagagctcaatcatacatttgcagaatatatgaatggtgtttgaaaatct

SEQ ID NO: 14786 - DNA, 12280 bp, Homo sapiens; identical to SEQ ID NO: 14411

SEQ ID NO: 14787 - DNA, 109 bp, Homo sapiens; identical to SEQ ID NO: 10553

SEQ ID NO: 14788 - DNA, 319 bp, Homo sapiens; identical to SEQ ID NO: 7553

SEQ ID NO: 14789 - DNA, 1052 bp, Homo sapiens; identical to SEQ ID NO: 6718

SEQ ID NO: 14790 - DNA, 300 bp, Homo sapiens; identical to SEQ ID NO: 7568

SEQ ID NO: 14791 - DNA, 184 bp, Homo sapiens; identical to SEQ ID NO: 7572

SEQ ID NO: 14792 - DNA, 147 bp, Homo sapiens; identical to SEQ ID NO: 6794

SEQ ID NO: 14793 - DNA, 143 bp, Homo sapiens; identical to SEQ ID NO: 7597

SEQ ID NO: 14794 - DNA, 1791 bp, Homo sapiens
ctgagagggccatggagaatctgtggccagccctccctggccccctgacctggcagaggaaggaaagggcattggagtaggcttctgtcttcaggccagagggggaggtggttcaggggcaggcttggtgcaccccttggctgcaagctatcacctccctatctgcttcctcttttctgcctcccctggtgcatctggtcacttcttgctgcccttcctgtgaaatcgtggcaccttggaccaagtcctgaagcacttgggcagaaggcgggagaggttgggtttctaggatccttgtttcccagggcctggctctggcctgggctcagaccactctggtctaggcaggctgctggggaaaggctggagctgcttctgctttctgctcctgttgccacctctgctaatgatggggaaaacctgcagagggctgtggttggagctgggctgaaggccggcaggggtgggtctctccatggcagtagcacacaggcaggcaggaagtggccctgtgcaaaagcgggaagtggcagttgtcaaacaggaaggggggggctgggctgtgggaggggcggggatgagcctggtagaaaggtgcgtggaggagggtccaccttggaaggtctgagcctctccctagtggttactggaaggaggggtgtctcaaggggagacacctttgcagcaccttgagatgccgagccagggccctcccactgtggaccaagcccattcagtggcctcgccctttttggggttggagatgctgcgtccagctgggatgcccttgcttttgggaaagatgctctagaaaccactactccatcctggaacccctctgctgccactgctgctgggatggaccctctgcttttttgcagccgtgggccagccctggatgtgactacaggacaggaagtgtcaggggaagagacaggagacaacagctggagaggctgggtggtggccgggcagtatgtggcagcaggaacggggagagcggggcaggtagaaactgctctgttcattgaggagagcttgtggatggcagggtgccacggctgcgaggaagaggagggaagcggacagtggcacttcctgcggcgttcccctctctctgaggagcccctgttgctgcccatcacctgcagactgtagacacaggtgggccccgccaaaacagggagggacactccacctccaggactgcaatggaggaccatgtggggagcccagaagccaggcaggagggcttagttgctgtgttgcagaccctgcatctgcctgggctgaggggacagtgggtcccattcacagtgtctctggtgatagctgtggccacaagcccagcccaggagaccctgtcaagcttctcactgggcccttggaaaggagctatatgccagaccttatgcaaaactcttgacctgtaccacctcagttaaacctcagatcttgctgtctctattttagaagtgaggaacctcttggccgggtgccgtggctcacgcctgtaatcccagcactttgggaggccgaggcaggaggatcataaggtcaggagatcgagaccatcctggctaacacagtgaaaccccgtctctactgaaaaatacaaaaaaattagccgggcatggtgatgggcgcctgcagtcccagctactcgggaggctgaggcaggagaagggcgtgaacctgggaggcggagcttgcagtgagccgagatcatgccactgcactccagcctgggcaacagagtaagactccatctcaaaaaaaagcaaaaaaaac

SEQ ID NO: 14795 - DNA, 108 bp, Homo sapiens; identical to SEQ ID NO: 11444

SEQ ID NO: 14796 - DNA, 105 bp, Homo sapiens; identical to SEQ ID NO: 7608

SEQ ID NO: 14797 - DNA, 162 bp, Homo sapiens; identical to SEQ ID NO: 6214

SEQ ID NO: 14798 - DNA, 301 bp, Homo sapiens; identical to SEQ ID NO: 7637
  misc_feature (98)..(98): n equals a,t,g, or c

SEQ ID NO: 14799 - DNA, 193 bp, Homo sapiens; identical to SEQ ID NO: 7396

SEQ ID NO: 14800 - DNA, 1791 bp, Homo sapiens; identical to SEQ ID NO: 14794

SEQ ID NO: 14801 - DNA, 285 bp, Homo sapiens
tggtcacacctgtaatcccagcactttgggaagccaaggcaggcggatcatgaggtcaggagatcgagaccatcctggctaacacggtgaaaccccgtctctactaaaaaatacaaaaaattagccgggcatggtggtgggtgcctgtagtcccagctacttgggaggctgaggcaggagaatggcgtgaacctgggaggcggagcttgcagtgagccaagatcatgccactgcactccagcccgagcgacagagcaagactccgtctcaaaaaaaataagaaaa

SEQ ID NO: 14802 - DNA, 98 bp, Homo sapiens; identical to SEQ ID NO: 11303

SEQ ID NO: 14803 - DNA, 153 bp, Homo sapiens; identical to SEQ ID NO: 6795

SEQ ID NO: 14804 - DNA, 203 bp, Homo sapiens; identical to SEQ ID NO: 7398

SEQ ID NO: 14805 - DNA, 166 bp, Homo sapiens; identical to SEQ ID NO: 7670

SEQ ID NO: 14806 - DNA, 136 bp, Homo sapiens; identical to SEQ ID NO: 6219

SEQ ID NO: 14807 - DNA, 300 bp, Homo sapiens; identical to SEQ ID NO: 6744

SEQ ID NO: 14808 - DNA, 150 bp, Homo sapiens; identical to SEQ ID NO: 7399

SEQ ID NO: 14809 - DNA, 266 bp, Homo sapiens; identical to SEQ ID NO: 7732

SEQ ID NO: 14810 - DNA, 142 bp, Homo sapiens; identical to SEQ ID NO: 7400

SEQ ID NO: 14811 - DNA, 166 bp, Homo sapiens; identical to SEQ ID NO: 7759

SEQ ID NO: 14812 - DNA, 268 bp, Homo sapiens; identical to SEQ ID NO: 7767

SEQ ID NO: 14813 - DNA, 160 bp, Homo sapiens; identical to SEQ ID NO: 7770

SEQ ID NO: 14814 - DNA, 368 bp, Homo sapiens; identical to SEQ ID NO: 6222

SEQ ID NO: 14815 - DNA, 4704 bp, Homo sapiens; identical to SEQ ID NO: 7404

SEQ ID NO: 14816 - DNA, 144 bp, Homo sapiens
caggcacataccaccacgcctggctaatttttgtatttttagtagagacagggtttcaccatgttggccaggctgatcttgaactcctgacctcaggtgatccacccgcctaggcctcccaaagtgctgggattacaggcgtga

SEQ ID NO: 14817 - DNA, 1419 bp, Homo sapiens
cagggtttcaccatgttggccaggctggtcttgaactactgacctcaggtgatccacccgcctcagtctcccaaagtgctgggattacaggcgtgagccaacacgcctggctgctgaatattattttattgtgtagagtaatgtattcattcgttggttgataaggcatttgggttattttcaccttttggctgttgttccagataatgctgctatgagcatatttgtacaggtttttgtgtggaaatatgtttttgtttctcttcggtatataggaaaagaattacagaatcaactctgtgcttaaccatttgaagaactggttttcttttccaaaatggctgcaccatttacagccctgccagcaggttataaaagttccagcttctctgcatccttggcaacatttgttattatttttttattatagccactcaggtgggtctgaagtattttgtcgtgttttttatttgtgtttccttgttactgatatcgttcagcatatttccatgtgcttattgctcatatgcatatgttctttggagaactgtctgagattctttgctcatttttaactgggttatttctctttttattgttgaatttcaatggttctttatatattccagatacaagtccttatcagttacatgatttacaaaaattttctaccattcccattccttgagttgtcttttcactttcttgatggtgccctttgaagcacaacatttgtgtgtgtgtgtgtgtgtatttttagtagagatggggttttgccatgttggtcgggcgggtcttaaactcctgatctcaggtgatccacccaccttgccggtgaaccaccacagcacccggcccgtttttggtttttttgtttgtttgttttttgagccagagtattgctctgttgccctggctggagtgccgtagtgccatcttggttcacggcaacatctggctcccgggttcaagtgattcttctgcctcagcctcccgagtagctgggattacaggtacacaccaccacaccctgctaatttttatatttttggtagagacagagttttgccatgttcctcaggctggtctcaaactcctgaattcaagtgatccacccgcctcagcctcccaaagtgctgggattacaggcgtgagccaccactcccggccagaagcacaatttttaatttttatgatgttcagtttatatttgtttttccctttgttgcttgtatttttgtgtgtcttaatatgtcttctaagtctgttttaatggatggattctccccttcctgcctctcatttatctgttgaagaattttgcctatttgacctgtagagtttcctatggtctggatttttctaattatgttcccatggtacagttcagcttctctctgtctctgtatttcctgcaaa

SEQ ID NO: 14818 - DNA, 122 bp, Homo sapiens
ttttttttttgtttttagtagagatggggtttcaccatgttggccaggctggtctagaactcctgacctcaggtgatccacccgcctcagcctcccaaagtgctgggattacaggtgtgagc

SEQ ID NO: 14819 - DNA, 131 bp, Homo sapiens
ttttttttttgagacggagtctcactctgtcgcccaggctggagtgcagtggcgcaatctcggctcactgcaagctccgcctcctgggttcatgccattctcctgcctcagcctcccgagtagctggaact

SEQ ID NO: 14820 - DNA, 426 bp, Homo sapiens
cctcagcctccccaagtattgggattgcaggtgtgagccaggacgcctacccgcaaacagaaactctttacccattaaacaataactctgtagtattccttccttcctgcccctggtaaccactatagtactttctgtctaatatgaatttgcctgttcgaggtgcctcatataggtggaattgcatatttgtgcctggcatatttcatttagcacattttttcaaggctcatccatatagcacgtatcagtacttcatttcttttagttgctgaatattattattattattatttttgagacagagtctcactctgtctcttaggctagagtgcagtagcatgatctcggctcactgcaacctccgcctcccgggttcaagcgattcttgtgtctcagcttcccgagtagctgagattacaggcg

SEQ ID NO: 14821 - DNA, 2173 bp, Homo sapiens
tagcattcagtaaatttcacaacacctttctgcctccctcttccctctcccctctccccttctccccacctcaccccacctcaccccctccctcttccttcctcttttccttccctcctcctttcttttttaccctctcctgcccctgacccggtacctataccacttggattatttacagcaaatcttacagatgtcagtattgtcttgttctgaagctaaaaaggacaatgagttcccgctgacctcggtacaatggatctcgctggagcacaatatgtattttatacaggcagtgaaaagcctacaagtaattgagagagagagaaatgtcactgtagcatttctgttgacactgcactctgcgtgtggagggaagcccggggcctggcggcagaggagcagccgcagccgcgctgtgcacccaggaacctgtccttcaggaaggaggcggcggtagaaattaatctgctcagattttccaactaatgaagtattcccaggaccgaaggggccacacagagacgtctgcggcgctgcttcccattcgcgcagatgcacacggattccgggcccagcgctaactcggatgtgttttccagctccgtttattgtcttccataatgcttaacgtactgtttgtatatgttgtccttgcactatattttgatatgctctcatatattttattcatctctggctttctacgaaggcaagctcgcagcaacactgagaataattattctccgccatcaatcaagagtctccgtggttggctcctcatgggatggccttgattttaagcatgaaatgtaactcttgctctttggggccatttcattctttgttcctggggcctgcctgtgggctcgtcgggacactagagagcaggcattcccgtggccgcgggagagccgcgttcctggctggccattcccgggccctctagaagggagcggctgagagctctttagccctacttggggtttaaaagtgaaaaaggagcagctcttcctggtggaaattgcgagcagaggctgcgtgagttccgtaactcgcacacagcctccatttggagccagaatgagcacgtgagggaccccgggcagaggggccagtgctgacattatgctccatgcaacctcccatcctgttgtgggagatggtgcagaccaggggagggagtcagtgtgtgaggggatgaggctccagtcctttcctgggcaccaaagccaaatcccccctgagcacaaggatcttccctgggtgactgcagaagcaaggagacctggcccaccgtccctgctggcttcctactgcccagccgcgtctctgcctccctaccccaaagcctgcagctcctaagtgcactatttgggctgtcttgtttgcagcggatgtttgaaagacagaccctcttctctagtgctggccttgagtcctcagagagctgctgtttcctgggtttctagctccatggaggcagaaagagaccccagggtggcctttggaggaagatgagccccctgggttaaccgagcttctgcagtggtgctcctgggtcatcactgttgccactggtcagagccagagtgtgtctgcctgtgctctcctgaacacagtggagctatttccaagttcaggtgaaggggacatggaggttaagcaaggccagaaagacagagacgtcctcttcccctggtagcaggtatttagcagatgggaaaatattagcagatgggaaatcagcagatacactcagctcaagatgcaaatttaaaagccgccagcccctgtactaaatatttacactgaacatctctactccatcatccgtcttttatttttgtgagcccgtacaactgctcttattacaaagtcatgtaaaagttgaggaaagaaaatttcacccttggaaacaaattcatgatgaattaaatttcagcatgaaaatagaaaaaaaaaattcaaatttctgttgacttttgggcttatgtcctgaaagagttaacatacattcttccatacataacttattcacgtaaattaaatggtacacccccaaaacttgtttccctaagctgatattgaaacttccattattgaacagtttttaaaaatgcaattctaatccctttttaagtttcaataccaaaaaaaaaaaaaaaaaaaa

SEQ ID NO: 14822 - DNA, 3291 bp, Homo sapiens
atcgtattttaaacttgagttcagacttagaccttatgagttgaaggtgatttcctgccttactgagtttttctgttatcagacctataatttgtttacactatactcttctgatattattagtagtagccaagattttcttcactcttttcttggaaaattggatagaactgttaaggtacagccttctgggttcttactgtccttgaatcttttcatttcttccttcctccctttcctgttgcacactaatgaagatggacatgaaatggacgtgaaacattaggcaaggcaaggcctgacagatttggctggtaaacaactagtcaactttttgaatttagacagttattaattacttaggcagagaaaaaagtagtccaaggtgccatttctctgtgccccttgtctcacacttgaaaagagtgacaccgaaataaaaggggctagctaacgattgtcccttgaatggtggacaccctgttgctgaggaatcattgttatactgcagctaagcctgtttagtctgcaaatgtaccctacaaggttgaggaagaaaggtctcatgtttcattagaacctgagaggagatgggaaactctcctgacagaagcatcctggggcaagagagaggtgagtggaaaacgtccatccatatagcaacttctcacaagcctctcttgtccatgttccaggatgattccatggccttctgccaagacagcttgcactgtgattcagaccttaacctctctgcgctctttggacatgtgcaaggtctccagagtgccatggctgatctctttcccttcagtggaggctcaagtagaagtactgtttcttctactaatgtcaccccctcatgctgagaaaaacagaatgagaaagggaaagagtggtgaagtggcataggcgataacatccttatctctcatcagtcacacattagtaccttaactttggaaatctagcctttgatgtttttaatttgggactcatatataaaaccagttttttttttttctcttttcgtagcatcttaataattatagcctacttctcttcacagtttcagctattttggaggatgactgtatgtattcctttttaaagtacctattgggactccccactgagaatttcgtatatgccacattaagtgcattttaattttgattaaaatttattcatcacttttcatgtgatacagtaacagcatttaaatgtttaatttcacttatataaatgttcatgttagaataacatacttaaaatctttttctttagatcattgtatgttattaaatgagcaatagtactaccagtcatgtcattttacatattgcttttggcactcatactctttattgctggttttatattaagatcaataataatcaagaggtctctcttttcagtaaatttcatgcagactcggtggcagaggctaaactttagtttgagagaccagtgaaaaaacctggaacctaaagttgagatgatgaagtcttacataatggccttggaaatagagagggagggctgaatctagatgggatatcacagataataaattgacaatatttgggaaaattatttgttgttagtagacctgtgcggtgatctggaagatgcaagcaaggctttagggtctgctggctttttcctagagtgtcaggagcatggtcagatctccatgattcttggagaaagctatgttggaggagatccttgcaattcctcctgttattaacccttccccttacccccaagagtagcagtgttttgctactgcaagctactagttggcagaaaggttattgagtaagtaggtggcagtcttccttaaccctgtacatgggagagcattagtctttgcagctgaagagactaagcagtagagaagattcctctcattgtcttgatgagggactgacagcttgctagcgaaaatgttgcttgaccacaggaatgagacttccatgcaccctcatcttgccattattaaagctatccagcatttgggtccagccttaagagaaggtgagagtcatgactaggccagtgaatataacagtgcatataaaagggacctagttaccagggagaaaacagaagtagaccactgaaagaggcaaaacctagtgaaaatagaattattgaacaaaatattgaacaaatacacttgaacaaaataataagggcacataagcagattgaattataacaaattctttagagctagaaaaaaatgacattaagttttaatgtttagattatttaaaaaagaggacacgtgctattaagttccaaattacaggcctagaaaatcagggggaagaattatgtcattaaatggaatgaaagtactaacagataaaatcaagagaagacgattagagacttacaagaagttctgaaggggaaaataaaaaaccaggtggacaagcaataactaaataatagatgggatgaagaaagacttgagactgcagatcagaacagctggctgttgtctagccaggagagaagtgagggaaacacacaaacacctatgcagagtctggcaaaatccctgaattccaaggaaaaagtaaaaatcctctaagcttccatatgaaagaccaagttgcatacaaagaaaaagaaccaaaccgacaccaggcaatcttccttaccacacaagcagaagtagaaaaaagtggaatgacgctacacagttgacaaagaactgcaactcaggaaccttgtactcagccaaaggaccctccacatgtcagaatgaaaaggagatactagtttatcctatctgaggaaaactaaagaaacaacctgtgaatcaaaatagagacctttatacaggggaagataaagaagacagagaacagtttaataaagaaaacagtagatcagtctcactaatataaattcaaaagtaaaaataaaatattagcaaattgaatctgccattgtatcaaaagaattctagactatcaacactagagtttatttcagacatgtaatgatgatttgttaccaggaaatctgtcaacataatttattctatcaaagggacaaataatcatagaagctattctcatgagaatttgaagtaaaatgggtataagaaggcagttatgcctgtaatcccagcactttgggagggcgaggcagttggattgcttgagcctggtaggtggagtttgcaatgagccaagactgtgtcactgtacttgagcctgggcaacagaatgagactcagtctcaaaagaaaagaaaaaaaaaaaaaaa

SEQ ID NO: 14823 - DNA, 398 bp, Homo sapiens
ctttggcttactgtgcctacaggataaagtctgaatgccttcatggaacgtacatggccatcagggatttggttccttcctgcctctccagactcatttctcaacacactctgccttgaacttttttctttctgtggcactgaactggagtttttgtatagctatcacattctttcttaccttggtagctgtttttctatctcaagtcctttctgccttttttgtaagttcgtttctctgctggactcttaatacaattttaattctgaaactccattctaatccaagctaggatagtttcccctttctcctgttttccttgtagcttgtgtaaacctattttgttgccttaatcacattattatagtatttccctgtttgtcacttttttgagtccc

SEQ ID NO: 14824 - DNA, 355 bp, Homo sapiens
gtgaaagaggtgacatttttcttagcatacacattatcagccttgaagtaattttctggttataaaggtttaggagaagctggtttatttagtaaattaattggtaatctgaagctattcagaaagttactgcgcttttccaagattactgttggtgctaccagagaagatttaagtagataatggccatttagagacagggccgttaggcaactcagaactttctatttcctagtgctttgccctcacagagatgctctttgtcatataaataaatgaagaaaagctgacattttaaatttcagcattgtctcattcagatagttaatttgaatctgatagggcaatacttcat

SEQ ID NO: 14825 - DNA, 2489 bp, Homo sapiens
ctcagtcgactgccaaagcaatgaagcgacctctcgaagcaactgtagacctggtactttgacctttcacctttcgctttgcatgtagcttttcagagaaccatctgagatttgtattacttgtaaaatactggttgcaaacaatcattattattaatttatggaaaaaatccaataaggtgtttagccatctcattctcatatgtaatctgtgaaataaattaatcctaacaaattttaataccttttccaaaagagtgaagcaaatttaaattatttgactcagaaaatgttcattataattcgtattaacctttaaattcaagaaattgccatttagttaaagaaaagaataggtattaataataacaccaatgcttcgtccccccttagaatagtttaactcattttaaaagctgaagccattttttttgttgttgttgcttgatagtttttcttttccttagttgagatgctaccgttttgggttacagaaatcatgctttcgctctcaataacaaattctcactcattcgacattgccgctgtttaaattaaggtgcatggcagaggcatctccttagctgtcatttttaaaaagaatgttgcaattgatgatctctgtgaacatggaaggtgtgtttgctttaagttagacatatcttatcgaattcttcatttctaggcctttccccctggtgctcttcatcctttaccaaagagacaagcacttgaaaaaagcaatggtaccagcgcggtctttaaccccagcgtcttgcactaccagcaggctctcaccagcgcacagttgcagcaacacgccgcgttcattccaacaggtatgtgcccttactgccctacgtcctgtgcccttctggtcatgtgctttcttctcatttctctaagctgtttggtggcatctagtttgcttttgaaggtataatacagtttgaaattcatcgttgtcctagctatctaaatgtatttaccttactttgaatgatagctaaagactgttaggattctaaagccaaatatttgatagattgaagagacagatttaacccatgagaaacagcagttagggcttttggtttcttgtatttgcacaagccctgtaaaattgtttatgtaaataagaccttttatgtgtgacaattgaaatttgtccttaactctgaatgacctaaaaatagcaattccagtaaatactaaccatttttttctatttctattcagagcactaaaacaatgaggctattcaaattaaagcaattctctactcatatttttatattcattctatctctttctccatccttctcaactttcaccaagttcacaagtatatagagctcttatcctcagtgtctaagccaatgcctgatactattacgtacgatgtgcattaactatgattccactaaaagatccattgtaatagtcatagaatcttagagtttaaaggactcttagtgatctcctcatccagctgattgttttacagatgagaaaactgaggccccctaaatgagaagtgactttccaaggtgccacaactaatgagaaaaagaactgagtttccctgtgaccaaacccatttacatcacattctaccacctgggcccgcctatatatacacattccacagagttctcctgaaaaaagaaaaaagcagataaaagtgaatttttaaataactgaccccaaaaagtcagataaaagtaaaaaaacaaaagtataaatcatgtcatccctcccccatttgcaccgacatctctaaccacagacacacacacgcacaccatacgcaaagatagtcaccataattgaccatgtttttcaccttttagtcaatgttagaagcaaggggtaacttaagtcctggtgggaagaccatccattgagttctttgaaagtcaacatttttcagcccacgatagtgaaatgaaagtaaatataaatgaataacaattctaacaaaaagagttttttgattcaaatccattaattagaacttttcgagcttattatccatttccttaaatcccatagcttatcagagttaacatcagagggaggtaaaatatttctgtgatattctttgtataaaatctacactttgaaatggattagtaacctgtgaacaatacatattttagttaacatataaattatgtgagcaaagtggttttcagtgtttttttcttattttagttttgaacctgtcttaaactcacagacttgtagaagaaatctctaattcagtatttattaggagttcacttttgccctattacagccttaattagtgacatcccagtgctgttacagcatagcagtgtcttaatatgtaatctaattgaaataacacatttgtaaaataattactagaaggtaaacttacgttaatgtcctgtgtggtttctacaaagtgtgtcattgtagacctcttggccactagatattttaagataaaaaaaaaaaaa

SEQ ID NO: 14826 - DNA, 6504 bp, Homo sapiens
ggcgggcctccaaggccctgctcccagtgggcgcctatgaagtcttcgcccgggaggcggtgggtgcgggtgcagctcgggccctgctgcctggagatgaggacgctggtcgagctcgggccctgggctggggactttgggcctgacctgctgctcaccctgctcttcctgctcttcctggcgcacggggtcaccttggacggggcctcggccaaccccactgtgtccctgcaggagttcctcatggccgagcagtctctgcctggcacgctgttgaagctggcggcacaggggctgggcatgcaggccgcctgcaccctgatgcgcctctgctgggcctgggagctcagtgacctgcacctgctgcagagcctcatggcccagagctgcagctcggccctgcgcacatccgtgccccacggggcgcttgtggaggccgcctgcgccttttgtttccatctgaccctcctgcacctgcggcacagtcctcccgcctacagcgggcccgctgtggctctgttggtcaccgtcacggcctacacgggtgagcactgcttccccttcccctgggcccctgaggacctctcacctgtgtggcctccatgcacactcaggcccgtttgcacccaggatagggggctgctggcccgggtggccaacaaacccacaagaagaggcggtgatttcctgggatctggcgggtagacgagggcctgcgctggacatggggtgcggtggagcagcctgtcccctgccagggccatcctgcccactgcacctctccccagtcgcagctattcttggtcctcccagaagttctgcctctggggtagtagggacagccgaggcagacgattcaaggcccagcccagtttcctggtctggtgtgggagtccctgcaccctctatcaccccttccagagcgacaggtcctgtctcacctgccccagttggcctccctggcctcctactgacacctgcatcctgcgatctctgcctgcacctggaccgaccgtggcacccagctctcatggtcccatcacccccttgtgagctccctccactcagaccctccgtctgatccagtcccccatgtctgctttcccctccgagcgctaggctccaccaccacgaaagcctttgctcagcaagttcccaggacaggtgtccacagcgctggggctgcagggagagccaggggagccggctcgtgctccaggcaccacaggaagggctgcagggagaatggtgccaggtctccttccgggggtccgaggtcctaatcaggacaggaccagcacttaggtccatggcactgcccacgacccagcactgggcagacaccacggaatctggaccacaaaggccacaggaaggtgccaccagagccctgtacagatggggaaactgaggcacgggtgagcgggagctctgcagggacacggctctgtggcagattgcccgggcctctgtcctgggtggcaccggagagctcccgtcaagggtcctgcctccacgaggcacagggcgcctggtctcagggacggagctgcccatcctcagggtcctggtttacacctgggcggccgcagactccatgtccctgtggtccctgccctccgctaggcccactccctgctcttccgtgcccagaggcaggtccccggtattggtggattctgttatttggggtggtcacccaggcctggggctgcaggacagcggcccggctgccgccgccttcccttgtctcacatcgcacagccatgtcgtcttctctcctctgctgctgctcgtttatttctgagatctctctctgtctctcctctctctctctgtctctcctctctctctctgtctctcctctctctctctgtctctcctctctctctctgtctgtcctctctctctgtctccctgtctctctctgtctctcctctctctctctgtctctcctctctctctctgtctctcctctctctctctgtctctcctctctctctctgtctctcctctctctctctgtctctcctctctctctgtctccctgtctctctctgtgtctttttgtctctctctcactatctgtctctcttagtgtctctctccatctctctctgtccgtctttctcgaaggccacatcccacagggtggggtgctggagggcagcatgggcggggcacgggatcccggtgagatgtcgcgagggtgttggacggccctggggggccccaagctgctgcccctgacccagaccttggctgacccggccttgctgcatcgtgtgtccatcggtgcgggggaccaggcggggcttcaggagccgagagcagctcccaggcctgcacacagtggggctctcggtgtggattcggtggcggggatcaggtcctggcctgcagaggggcgtcaggcagggctggggaccagggctgtctgtgctctgcccacagccgggcccttcacgtctgccttcttcaaccctgccctggccgcctctgtgacctttgcctgctcgggacacaccttactggagtacgtgcaggtgtactggctgggccctctgacaggtaagggcaggggcagggtggggtccctagggctgctggggcccacagagcatcctggcacgtggggtcctgcagggtggaggtgagggtgcctggtcagtgctcctggggaggtctctgcagtgggcatggtttcgggggtaggggctgtgacggcatgtctcactgtggacaccgtcccggtgccgagcaagctgcagccaggtaaggaggccacaggctggggaaaggccaaccttgcaaggggtgctgggcacacgggggatggtgtctgcagtggggctccatgcacctggggttcccgtcccaggtggcatctccacacacccagagccagactccgccgaggggggctcattctggtgtccctaaagcctcaggaggcagagagccccgcttagatgatatagggtgccatcgtgcacttatagggctgtgagcatggggctggagcagccaggccctttgcatcctggtggggcagacccgggactcgctgatgcacacaggggaccccagagttcccccacagtgtgtgcccctcctttcttatatcctggatccaagcagaggagcagcatggggaggtcatggagccccctcttggacctagatctggggattctggcccctggcttcagaggcccaggtggagcccacaccttctcctgcacctgctctcagacactcggctccacctcactgaggtaccagaagggcagctgggttcctatggaattctggaagcttttttcagcttctgctggctctacactggggaggtctcaggggcaatgcctcagcctccccttggggggaaagacaggagctgggggtctctcaggcacctggccctgcgatggtgacactgacgtcatcgtgatttgtcgccatggttctgatgtggtcacagtctctcaggcatgtgcagggtcctaggaagcatatgaagtgcatcaggaaccccctcctgcccccgttgccgaggcagcactgccctctgctaggaacagctccgtgttggcctctctgtccccacacactgggcctgcagggcttctccgagactcttcagttcaggtatcaaccctgggctgtctcctgggatgtggggggcggatgttctttccttgcctccccacgctcctcctgcggatccttcactccgggtgggtcggcctcttcctcctgatcagctccagagccccctctagttccctggcatggaaacacggcccgggtgagctgtggtggccccggaggcctctccgctcctgcacaggccttgcttcctgcgggtgacgaggtcctggactctctcctgcccaggcttctgggtgctttccttagttcagcaccagtgctctgtgtgggcagcgtctcccccgaggatccgcagctccgggttacccgcaggcgtccatctccggtatggtgctgcccttcactgatcctggttgtatttctgtttcctgctttcctcatcgcctcctgtttcggttgattccttctttttgctggtgcccgtctcacagtagcttcctgagaacggggacctggcaggtacacttcagacctcctgtgtctgaaatagtgtcctggttctgacctgcacttgagtgtcggtgaggcctgggcagggttccgggtgggagctcagtttcgtcctgagtttctcaggccccaaccatggcctgtggtggcttcacgggctacaaggcaaaggacgcaaacgaagaggcttcacgtgacagggttgtatgctcagccagctctggaggctggagtctgagctggcagcactgacagggtcagctctcctcggaggctgctggggaggagcctcctgcctcttccgggctccgggggcctctggcacccccggtgtccccgggcttggagacgcagcactcccatgtctgccggttcccctggccgcctcctctgtgtcattgtctgttctcttcatatagggacaccagtcatcgaattggaggttcactctactcaagtatgacgtcaccgtgatttcactgattttatgtcccaggccgtattctaacaagggcacatcctgtgttctgggaagggcgtgtcgctggggaaatactcttcacccggctgcaacctctcactgtagaactgcctctgtggagaagcccaaagggcatttgcggcttctaggagccaagtaggaggaggctgggatccgtgtttcaggcgggactccaggcttgggcgggcctgatactcgagtccacatgccccctctagagaggaacctgtctcctgccagggccagggaggggggcactggctgcttctgtattttggggtttggggccctggagcttcccatgcggaattgccgtccctcctcctaggcgagtcccagggccaccccatcccacagggacccgggcgccagcttctgaaagcatggggcatctgcggaagaactgggttgtttcccagctttcgtccctgcggaggggcgatccggcccctccatgtcagcagtgtttggtcgtccacatgcttgtcagccccacgctgtgctcctgcgtctcttcccgtctcatccatctggatgcttgacacctctgacagcatccctttcctgtcatcttagggcagcttcaggaaaccgaaaaacaggcttgtgtccttccattaacccctttatccacaagttcagtatcagcatgagccctggggagctccaaggctgcagccaggagccccgtagccaggtgtggacatggggctatctccctgggtgtgagcggccaccggcacctgctggcagcacccctgagcaggtcatcccgcctccctgggcctgccctcctgggaacagagctaggaccagtgtgggcctggagggccgagtgaggggcaactgtaggcaagctgtaggcacaggggccactgtcaggagccacagcagctgcaggtggtgacaggcagggccccctcaggccagccctagtggagctcacacactgtgggttaaatccttagaggagtgagatcaaacttgaagaggatctactctccccttctgcccggaacacctgcccttcccaatgacctggaaggcaggcggggatttaggagtctctgctcctggagttctgggagaacgttcgcatgaggatttagccaggcccagcctcccacccaggggcatccacatctttcttgtccactcacatcccccacctctacgccaggccacagccctgcaagcagccaccctgggacgccacatcaggtcccggaggaaaatggccacagaagctctgggagtggctcaggacaatgtggggggaggggaattccagtcactcatcccagagggtggtccagaagtacaaggaaccccaccggcttgcccccgtccccatggctggcatacccagagagaggggcatgaccagggcgggaagaccaggaccaggcaggagctgggcctcagggttcttggggctcctggccaggctgcctggctcgcctgtcctggcacaggcctgggagtgggtgtcctgtctgtgtttgggcccaggagcccgcggcccacctgggacctgccttctcttgcagggatggtcctggctgtgctgctgcaccagggccgccttccccaccttttccagaggaacctgttctacggccagaagaacaagtaccgagcaccccgagggaagccggccccggcctcaggggacacccagacccctgcaaaggtgtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttctaaga

SEQ ID NO: 14827 - DNA, 397 bp, Homo sapiens
aaggtctccagtggtgtcggattagaatatgaggaatccgtctgagctcattctccacaggatcccacgagggaaagcctggcttttccctgtgcagatgccaggcctctacaggttccagaaggttcctctgctcctctgagagggcagggcacttgcacagggaacaggcagccgaaggcagccacagccctactggaaccagggtttctctgcctcctgggaagaggtcagtggatgggttggggagggggacaggcggccttcctgtgggagtcgaagagcctggggcctcccctccttggaggcgaccagacaccttccctaactggaggaaattctgaaccccagacctggaaagttcaaagctgaaataaaatcgccccttgttttgcga

SEQ ID NO: 14828 - DNA, 16106 bp, Homo sapiens
tggaaattcttttggttcatgaggtggtgtttggtaatagaaagaaagggtcaaagttggcaaagtgatgcaggtttagtgtcctttatctgaaatgcttgtgaccagagtgtttcatattttgtatttttccagattttggaatatttgcatatacaaaatgagataacttggggatggaacccaagtctaaacatgaaattaatttatgtttcatatatatctcttatacacatagcccgaaggtaattttatatgatatttttagtaattctgtacattgaagataggaagggaaaaaaataataattctctgcacgaaacaaagctttgactgaccagcacatgaggtcaggtgtggaattttccaccatggcactcaaagggttttgaatttttagatgagggatgctaaatctatatgttggattgaacttccattgtagaaaaaacttcttgttaggagcagactcctaattcgcctattgattgattgattaattgagacagagtctcctctggcccaggctagagtgcagtggtacaatctcggctcactgcaacctccgcctcctgggtttaagcaattcttgtgcagcttcccaagtagttgggactacgggcacataccagcaacgcccagctaatttttttttgtatttttagtaggcacggggtttcaccatgttggccaggctggtctcgaactcctggcctcaagtgatccacccgcctggtcctcccgaagtgctgggattacaggtatgagccactgcatccggccttaccttattattaaaaagttttgtgccagccatggtgttgtgcccttgtagtcctagttactcaggaggctgaagtgggaggattgcttgagcccaggagttcaaggccagtgtgaacaacagtgagaccctgtctctcaaaaaaataaaaaataagttttctgtatatttgtcaactaattagctttaggggtatgacgtggggtatgatacggaaagcagcttcagtttcatgatactaggatggaaatcaatgagaaaaacttggaaaccaactgcaaaaaccttaaccaatcacaattttttatgtcatttgtatactatttatgatacagacatggtatatactttatcttgaaagttctaggcggaaaggttaacatttctacttatgtattttcctgtttttgtgcttatctagctttttttaaacaatttcttctttgtattacagtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggtaagcaagagcacatttttcttcctatttctttttgtgtggaggtatttctccccacccttttttccccttctggccaaggagggagggaggtggctgtccttacagatgttcataggaatccctttggacaattaagaaaattaaagcgtgaagccttattttccttagaaataaatgttaaatgaatattttgattgaacttgtatgtaatatgaatttcagtgaaggatttttatatgttggagcaagattttatactgtgtgtaccatgactgcagactagagttatgccaacctatgcagtgagggaagagataaccaaaatattgcatcctgattagttcactgtttccagtattaattttactttgcgtcagtatttgctatgtaaaatgtaacaccattcagacatagctgtggaatagttcagtttactagtagctttaattaaagctgagccttttacagctacttggtaattaaacaaatttaaaactatgattaatgtatttgttaactaattagcttttggcctttgatagaaatgtgtaggtaatataaattttagaattggtcttgactactaaactattgctaaaattattaggctaaaagtttttgtctcatctgcaaaaggtgagattatcacctatttcatgggaagatttagattggtaataatgtagtctgggggccgggcgaggtggctcacgcctataatcccagcactttgggaggccaaggcaggtggatcacctgaggtcgggagttcaagaccagcctgaccaacatggagaaaccccatctctactaaaaatacaaaattagccgggcgtggtggtgcatgcctgtaatcccagctacttgggaggctgaggcaggagaatcactttaactcaggaggcggaggttgtggtgagccgagatggtgccattgcattccagcctagggaacaagagtgaaactccgtgtcaaaaaaaaataaaaaaacaaaaaaataaataatgtagcctgggtatgttatttccactcatgtacttgaatcattcactgtgctagttttcatgctaaaggctgcatacgtaaactagtctaaacatcaatcatatgggaggtcttactgttccttctagtttgtagatgggagaactgaaattcagagagattaggttaattcacccaaagttgggtgagtaattgggtaaagattcaaatccattttcttttaatccaaaaaggatgctttcttcaatgtatcataccagtgttattttacctttattaaatagttacttatttcaataaaacatttcaccaactcagaagtatgttatttataattgtattagctatgtatatattttttaattttttttctctcattgaaatgtgtttgcattgagccaatttccggttcttacaagaatttttttaaccattcagattcttactttcacagtgacttgttctttttcttctctcatcagtaacaacatgacctactgtaagtagtaacaattctgatttatgagtcctggaacgaggtttttgctttataatgaagttacggaatctttgggttggaaaggaccttattaaaagttatggctgatttttttttttaaagaagctgctaagcattggagctcagaatatatgctttttaattcactgaagtttaaaaggctagtctactagaaaagactcaaatagagaaaactctccttgctgcttttcaatctaggtgtgcaagctctacagctactactggctccatagttagcattcataccaatgcatacagattatccagtagatagcatagttatctatctactattactagttatctgtaatatctactattatccagtagaaagaatctgctgacatctgtattgttttctgtgtcctttaccccttctgaagttgtcatctctaattcttgtttatgtccagtaagttattttattgaaaagcagcctgttttgaaagatgtgtttttctcccacagatctcctgtgtctcatgatcaggtgtggagttgttaaatatttggtctaattcttgtttatttctataagtcattttattgaaaagcagcctgttttgaaagatgtgtttttctgccctggatctgttgtgtctcatgatcaagtgtggagttgttaaatatttggtaactaccatgaatataagagggaattcaacatgcttgccttgaaattattattggcttcttattcatgcaggctctgcattagctgctaatgtatgtaaaaagattactggacgtcttacaagtgcaatagcaaaacaggaagatgtctctgttcagctagaagccttggatattatggctgatatgttgagcaggtaagtgtgcctgtttatttccgttactcgtaatacagataactacattaatttactaaaaaccctttctagtaaatataataaaacttggtcagaaattattcatatttaaatggtggctgttttatcaatttgtgtgattgggagtgagggggaaataagctaattacactaacatataagtatataatattgtatagtaaacattttgtagttctttaaagtaattaataaaatttgtgattttaaattttttttagcacggttcatgttttgttttactcatatattcttgcattcagtggtgtatttagataaggagatgtgctggtagttacggattttccggttaaaagaatgctggtaatcttcggtaaccatattaatagtgcatattttaggggagggaggaccttggcttttatgtatttgttgctttttcactttcctttggaagtcagatgttagaacatagacagacctaagcaactcctaggagaaaataccttaaaggacctgtcaatttctgattctcatattcattataggccaccattatttgtgtgtgttttttgtggcaaattcatgtcaacttaaaaacaatcaagtgccttcaggtgggtgtgtgggtgtgtgtgtataaagtgaggagctatcatcctggcactgaaagagcttatactttacgataggacataagaacaccgatggctacagggcagaatgggactaaagactaactgggagcatagtgtgttttgggttttaaaatggaaggattcaagaaaattgtttttatggaaagtggcatttgaattgggttttgaagaatgggtagcccttcaatagttagatgtgcccaggtgtagaatacataagtagtatgcgaatggggaagcatattctagttttctagaatagagaatgaatagaaaagcagtaggaaatcattctgatagattggggtcatgttgaggtggatgaggaatttatgtttaatttgataaactgaaaattcagactttttgtcctgtgcatgatttaatcacgaacactgattgtcctggcacaggtttgggtagtagtgactcattgaactatacatttgagatgatttggaagaggggtgttggaacaacaggaacaatgaaactatatatagaggaaagccaataagggagagggagaactcaagagaaggtcagttttttagtgttgtgaatccccccctaaaaaagcaatacagaaagtcagaatacagaaaatcatttagatttctttttttttttctttcttgagatggagtctcactctgtcacccaggctggagtgcagttctgtgatctcagcttactgcagcctccgcctcctgggttcaagtgattctcgtgcctcagcttcctgagtagctgggattacaggtgcccaccacctccactggctaatttttgtatttttagtagaggcagggttttaccatgttggccagggtggtctcaaacgcctaacctcaagttatccacccgcctgagcctcccaaagtgctgggattataggcatgagccaccattcctggcacagaaaatcatttagagattttggaaggagaaagtgacaagatgattgtgtagttttggttgttgttgtttgtgtttggttttggttttgagacaggttttggcccaggctggagtgcattggcatgatcatggctcattgcagcctcaatttaccaggctcaggtgatcctcccacttcagcctcctgagcagctgggactacaggcatgcaccaccacacgcagctaatttttgtgttttttgtagagatgaggttttgccatgttgcccaggctggtctcgaactcctggggtcaagtgatctgcctgcctcagcctcccaaagtgccgggattacaggtgtgagccttcacacccagacttgtggtttttgtttttgttttttaatattttcccaagccaatcaattagatatcctataattggggatttaggtctagattcccggagtcagtttggcaatgtaaatttcagtgctgcattcacttagctcaggtttcagttgcattggtagataaagtgataatttaatttttctttcactatgaattagtctcaactaaatttgtgttctgaatatttgcattgaggtcagaggccagacatttagtagtggccaggcatcttgaattcatttgttgttttctttctttttttattttattttaaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtaagaaatctttaaaagttttacagttttctttaattaaaaaaattaatgcatgtttttaaagaaccattatgcttttcttaggtgaataccttgagaagataattcctttggtggtaaaattttgcaatgtagatgatgatgaattaagagagtactgtattcaagcctttgaatcatttgtaagaaggtaagtttttaagatctctattttttacaaaaagtttttccttaagagtagaatcataaggtctacattaggtgtgtgaggagaagcggccttttggatttcagatataacagacaatacagtatttgaaactaatgtcatcttgctattataaaatgtggtcatcacatttattttgaaaattttccttgtcattgttaggactttatttaaagaattttggaaaggtatttataattattttgggtttactttagaagggaagaaatgccagtgtaataatgtagtctgtactgaaagcccagcaggataaattattcgtcagaaataagtagtgaattgccttttcaacaatttcttaggtcacatccattttgctaggtcagtgattctcaatttggaaactgattctaatatattttttaaaagcttagtaaaagttgtgtatttgtgtactagaaggcaatacaagataagtaacattatttttcctcttgactaatgcagtagcatggtgtcttgagaccttactggttgttttctgcatttatcccttgacactcctggttttgagaagtggcttttaatcataccatattctgaaaatcagaaattgttagattcatttttgttcctttagttgagaaacacaaagtattcttttatttgctggccctgtgggcatttatatgttctgtcctctcattacatcggtagaagaccaagcctaggtgaatatgcactggcatttccacaaataatcctagttactgaagagcacattcatctgggtttggttttctaataacatgttgattatataccgatttctgtctatactgccatacattaaccataacatagttaaaatcgggattaggggagttcatcttaaaattgattaaataagtacaatttgaaaggtaaaccttttaaaatagtaagtccatgggagagaaagagcaagaatcattggtgctagatagtctgggaactactgtcctatgttattgctggtaataaagcaaaatgtggcaggtaatgaatcaaggagtaaaatgcagctcttcaaggcagcttttgtttttgtctttagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaaggtattgcaaattaaatagaatcttttgagtttttgtgaaagacacttatagatggagatgattcttagtccaaattgtactgtttgttttatttagttataatagtgaaaagggaaatgatctcaatatttgacaacagcaaattaagttagagggcatccatgtattgaactgttatgcaacacattaaaaaatcatgtctaaaaatcattcattaatgctgttaataaggtgagtgaaaagtatgtagcaaaaattgctcaccatagcccaattttatttctttaagtatacagaaaaaaatctgtatatttacaactagtactattaccacttgttttctcttggctaggaactatgtatgatttttggttttaagtactattcaaattttctacaaagcatttttgtaaggagataaaccaaggttttagaaagaattgaatctgtagatatacatatttagggcagcttggcttgaaagaatattagtttgtttattcatagttcatgaaaaattctaaatactgttcgaggccccatttaacattcattaatagcttacaacatttctgaggctcctaagattgatgtaatcacacgatgatttatgatatttactctggaaagtagtagcagcacttcaaggacataggggttgctcatgtcagttgtttctgtttgtattggaagaatcataataacaaatatttaagttggtaaattactaggtaaacaggttggtggattttttgttatttttgagaatactttttagtttgattctttgaatgaatttacataacagctttcctgtcaagtcagtaatttcacccatctttaaaaaacaagtaccaaaagagtttcttaacaccatatactcctctagcagctgctgcctagtttctctcctccacaacagagctccttaaaagaatgcagttccattttcttttttccattctctcttgaatccactcctccagtgatggatgagattgcaaatgtttgactctgcctatcgtattactcagtctcggcaacatttctttatttagcttctgggataccattctagcctggatgtagtcctatcgttgtgattactccagtcttcgatgctgtttcttcttcttcaccctgaccactgtacttacagtatcccaaggctcagtccttgaacttacctgttatactgttgatttttttgttgatctcatctagtctcctggctttaatatcaatatgctggcaacccacatcctatctttaatccagatctcacttgtgaatccagattcatatgcaactgcttaattaatattgctgcttggatatctaaaatatcttttccctgccccttccccatctcccacctaacctgttcttctttagccttttccatctcagaatggtacctctattcttcttagttgatcaggccaaaaaccttgcagtcatacctgattcctttttcacacatccctcagctagtcttccacctcagaactatctttcattttattgtttttattttgtttatcacacttagtaactttctgacatactgtaattgatggtctcctacctattagaatataagtttcatgaaggctagatgttttaatctcttgattgactgctttattccagtgcctaggacagtacttgacacacaggcaatcaataaatgggttgtattaatgaagggaaactttagcttatattttaatatgaatatcttttgaagaaagcagtagcaatgtatattccaggttttgaattttgtttttttgtgtgctgtataacaaactaggtacttcacctgctttatcacttagtatgaattatacccattaaatgacttttctaccatggtgtttttgtgatttataaaatcaacgtaattttagtgaataaggacatttgttaattttttataatcttgtttttaataaagcttatatttctgggaggcaattgccatagtgtattgacatggaaaaaattttatgtgctcttaacttgatagtgtattttggcagtatcttttaactttatttgaatagatattggtaaataagcaaacgtcttgcatttagcagtatttggttgtattttcctgtaatgtgctaaggtgaattttaagcttttgagttggaaaattttattattttgttgtatactgtagaatcttctaaggcctagctggctacatttgactgtcaaactaagctaattggaataaaagccagtaaaaagttactactccgctctattatttcaaggctatgtatagtcttatctaagaataaagaaattattgtgagataattttagactatcatgataactgctaatatttctgccacctttctgacttcatattacccaactaattaaacctgatggtgttagaaagaaagattttctggagatttcacacacatgttatccatcaagtatagataagtgagatacaattcttagtgcttttgctttgaatgtttaaggtttagcattaggggaaaaaatggtcctctgttaagtgtgcagcattttcttggtataattaagcaaaaatggttttgttaaagtacattaagacaaaattgtgaaaggtttagaatatacatatttgttcctcacagcttatcaacaagttgagtgaaaagccttgtagtcacaaagctgatgtcaaccttctttttattcccagcaaattagttctacagtgttttgggattggtaaccattctttttatcacctactctattaccacaaatccatttcatggtttgtcttataaagtccctgattgtttgcttgatttttcctatgctgttaagtaagttctttgaattttgtttcaaaggctgggaaatttatgactataaatatttatattctaaagaagttgaatgtgttaattgatgattttaaagggttaaaataagcagcagttcattacaaagtaaatgagaaaatgtttaactaattaaaaataccattatgtttgttttttaagtttaatttatgtgcagatttacagaaataacaagctctttgttcaagttctagttctgttgaaacctacctgttgctgtatatgttaccggaaagttagattaactgatttggttaagaatatcaattgattttctgttttaaatgttatacttctcttgtcattaatagcctgtttacattaaaacttacccttagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggggggttttaaagtaaagtttagaaaatcatgatagtaaatgcaatgcttttaaaattgtctttatatggaaaggtgagttccagaatatctatagagaagcagaaagttctaggatatgtttatatagttaatgcatgttcatattatgttagttgtaaactattctaattgaattattcttggctttacatgataatatttaaataattttaagattcagtaaagtagtctttatctttgatgttaatagagaagtcttagagctgtggagtcatactacttgcgatcacataactgacttcatttctaatttaggtgtgtgatcttgggcaagttatttagtcattttattaaacctcacttttcttatttgtaataagaacgtacttagaaatatctacctgtggttgtgagagctggatgatctgtgtagagcattcagtgtagtgcctactacatatatgcttgatatatgccagtacttactaataaaatacacattttttcacttgagggcatttgttttctaagatcctaaacattagagctattatatgctcccatttattgaatatttattacataccaggcattctcctatcttatatgtaatctctacagcagccctatgggatgcacaaatagtaggtcaatttttatagattacaaaacagatattgccagggattaaaccagtggagaggacgggacacacatactgtatctatcttgtttttaagtagtacaaataaatacatttttgtggtgaacttactcataaaggtgaatgttgaagattaattgtagaaggaaatgagataaagtgtatggaggacatatgcaagtgagtgagtatatagaagtcaggtattgctcagtagagttgccaggaattctgacaatgctatggaaagttagacattttttttgttttgtctagttcttagatcattgtgtaattagggtatgtgtccatgtagtttggttgttgggatttttcttggctttttgtttttactctgtacttgctttgctgttgaggtattctagaagctccgttgatagctttgcatccgtaagatttgttagtagagaccctgtttgttttactgactagcaaaacattaggaagtttagagcagatgtcttttaatcatacccctgctgcttgtagctacatttgaagtgaggttgattccttctaacagcaaatggaaagtaagaaaaggacctgttcgatggttgcttttccataatttgtcttgtttcctttgatttttatctgtgctgttgtcattcaaaataccatttataaattaacctcctaaattttttattgaaaatatgatttgattaatttctttctttctctttttttttttttttgagatggagtcttgctctgttgccaggctggagcgcagtggtgctatctcggctcactgcaacctccacctcctgggttcaagcgattctcctgtctcagcctcccgagtagctgggagtacaggcatgcaccaccacgcccagctaatttttgtatttttaatagagacagggtttcaccatgttggccagaatggtctcgatttcttgacctcgtgatctgcctgcctcagcctcccaaagtgctgggattacaggcgtgagccactgtgcccagcctattaatttctttttagtcatgtatgtttcacaattaaaaattaagtagggaagactattttgttgctctctggaaagctaaatgatagcttttctgtaatttcttatcagtatcaagcaaatatagttacaagagaacatatataatacatgcaacaaacttgatcttgtgttagcaatagcaatagatagctgaattaggaatttaacaaaaaaagataaactcttccctttatcctcattctccataattcatgttaagtgtactgaggaaataccaacagctgaaccagctaatgactatatgataattgcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggtatgaaagaaacataaatctcttttgggacttattgtagcctttttgttaggacttagataagcttaaataattgtttccttttaaaggaatatatgtgacaacttaatatgcacatagagctaactttttaatctaacaatcttgaatacctgaagttagaaatttgtaagtaaaaggttaaaagtctcaccctaaaatatttggctgtaatatttattgtagatggtgaaaatttctacttatagaaataatataatgaagtgggaacattagcagtactataggggttgatttttaatttttctttcttaaaagtctgcacagcaatgattggattttttgttggctttttaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggtaggtatctagattttcttacttaaaaagttttttattgatagttggttgccttaaaagacacctaataaagaagttaagccatgtctatattttcttaaacctaaaagctaagtatgtgatgaagaaaaactgtctttcgtagtatggagtgatattcaaatgacattttgttgttttaaaggatagtgtggtaattagataatggttaaatctgttctaattcctcatgataactacattttaatgttactatattgtgttaaaatgtggaaaagatgtatctaatgaattaacataatctgaagagcttgttgatactaattacaataagtataattggtgacagtacttttttcaaatggaagattctggaagagttttcagatttaccagtgtcatccccattagaacaagtaaaaggtagtaatattaatagcagtaatagccattcattcttagacattgctttctgttttagtaaaaaatttgaagatttttaagcggttttggatttagctagttctattttgtgagggcgagatcgtccactgctgcttcaagtccctccttcccagaaggaattgtttctttgaaatctaatgggattatattttgtgctcataagtaagttaattttgctcctttggattcatgtgtgcaataagaaatacccttcttggccaaggagaattctaaggcattgaagacactggtgttatttgaagtggtttaaaaatgatgtccgtgagttttagtggactacataccaatagacttgcaatttatttttaactaggctcatcatatgcccgaagctcagtggttacggctgtgaaatttacaatttctgaccatccacaacctattgatccactgttaaagaactgcataggt

SEQ ID NO: 14829 - DNA, 299 bp, Homo sapiens
ggttaagtttttgaagataggggccatactgtctttgttattcaataattttgaatacagtgacttcttaatataggggtccttaaaccctgggccatggacccatacagatccttggcctgttgggaactgggctgtacagcaggaggagagcagagggcgagccagcattactgcctgagctttgcctcctgtcagatcagcggtggcattcgattctcataggagcacgaaccctatcgtaaactgtgtgtgcaaggcatctaggttgcatgctccttatgagaatctagtgcctg

SEQ ID NO: 14830 - DNA, 2600 bp, Homo sapiens
agtcatggctcactgtagcctcgacatcctacctcaacttccgcagtagctgagactacaggcacgcaccaccactaactaacgcacctggctaacttttgaaaattttgtgtagagatgaggtcttgtatgttgcccaggctgatctcaaactcctggactcaagtgatttgcctgcctcagcctcctaaaatgctggattacaggcatgagcccccatgcccacacgacagaacctctttagaacatgactgttaaagctgatatttggatacttttgattttaatagcaataacaacaataataaagactgggtgggactgaacttttaaaatactcttgctattgttcagttggttttcagctttgctcaggcctatatgaagtttacctttgggagaaaatgaaaccttgtccaatgggtctatagcttataccacatgccgtattcctatctatgctatgcctcttatctcttctgccagtagtttttctccccagaatctgtgcacattaaatttcatttttccagtagttcatttttagaatctttgcttcagtgatgaattgaaaagttaaaaaaaatctgatcgcttgtaagtaatttgagaagttctctgacccaccttacctgtttattgtgcagtgctattatgagggagagtaaatcaatgttatatgtttctgcaaaagcagcaaattacaggagaaacatgagaaaagtcacatctagtttgtccaaaagacattatctctttatgaggacctattttattaatgtaactgtttttaaataggattaatcaactttaattataacttatgaaaagtgccgaatcaggtcagtgggctatataaaaatacgcaaggtcattagaagcttattggacttgttgagtatgggttcttttcttgaattttagtgatgataacctcacacatagttaagtgaacttcgtgcctgaagatgggggtcctgcctagacaaatgagcaaaaatgtgtcttttttcctgaactggaaaagctagtttacagagtgatgacttctttgtgattaaagttaccagtttctgtaagtatggaacacatcgcttctccattaagttggaagcttgttaatcagctgattttaacgttcaccattacactggagttttgggttcatatttagttcttaatctttctatcatgtttaagtttctcatgatcttcagaaataaaactggaagaaatggatgtgcattcctttctctcctgattctgttatttaaattggtaatcctacagggtttctgtttgattttgttttgtgtttttgccccacgagaaagctaaagaaactttttgacattttaaagatgagtgtgtactcctcccttccctttcccctccctcctcctcctccctccctttgccgtcccctccccctcatttcttggaaatttgacttttttttctgtcatcggtttgaaattactttattcagttatatcattctttccaagtttcagcttattttgtaagcaattctcttttttcctgttctcattaccactgttgttgatcttggtcaacagtggtaatgttctcgctttgaaaataattttcaggggcctgtgtttctcagcctcactaagtggcgtgaagcactggttaaacagaagacagttaagtagctagtaagccaataactgtcatggaatagacagagacaacacaagttctgacatagatcaacctagtttgtgtataaatacaaatttaaataatatttaaatagaaatctctatttcagtggtccccaattttttttggcaccagggactggttttgtggaagacagttttttcatggacctgtgggaggaggggatgtgatggttgaggggatgattcaagcgcattacatttatcatgcactttatttctgttattactgcactgtaatatataatgaaataattatacaactcaccataatgtagagttagtgggagccctgagcttgttttcctgcagctaaacagtcccatcagggggtgatgggagacagtgacagatcatcaaacattagattcacataaggagcctagatccctcacatacgcagttcacgatagggttcacgctcctgtgagaatctagtgccaccgttgatccgacaggaggcggaattcaggtggtaatgcaagcagtggggagcagctgtaaatacagatgaagcttcactctctagcctgcacttacttcctactgtgtggcctaacacgccatagactggtactggtttgtggcatgggagttggggacccctgctttatttaatcacttataacttataatcacttagatgctctaagtcatctggggggtgagaaggttggaaaagaaaaagtacattagtgagtgagtaaagattatctgggattgtttcttagatgaggatctatttgatgttggtgttggtctactgtgaactaaatataactgcattggagcctaagcgcagatgtctgcgtcatggtttattactcctgtgttcgtttcaaggagctcctgtgatacctgctgtctccacctaaaaaaaaaaaaaaaaaa

SEQ ID NO: 14831 - DNA, 242 bp, Homo sapiens
tgctgggaacacaggtgtgagtcactgcacccagcctatttatttatttttaataattaagttgtacataataatattcatgatgcacctgcataagacaggtttattttattatcagatattacctcccatattgtatggaatttttaataacagttgtagctgatgctccattttgtagtctgatagtttcactttgtcatatttttatctatttctatggtctttataaatatttttga

SEQ ID NO: 14832 - DNA, 2109 bp, Homo sapiens
ctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagctgtcccgctgtctaactgacattgtgtgagatgcttactctctctgagctccctcctcctggctcccaactttattataaaatggggaaaatgattgtgcttgccctacagaattgtagtatgaattaaaagtctggatttaatgtatttaatatagaaaattttagcttttattaataaaagtttttggcatacaagtcaa

SEQ ID NO: 14833 - DNA, 2108 bp, Homo sapiens
ctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagctgtcccgctgtctaactgacattgtgtgagatgcttactctctctgagctccctcctcctggctcccaactttattataaatggggaaaatgattgtgcttgccctacagaattgtagtatgaattaaaagtctggatttaatgtatttaatatagaaaattttagcttttattaataaaagtttttggcatacaagtcaa

SEQ ID NO: 14834 - DNA, 2108 bp, Homo sapiens
ctccgcactggctgactgattttatagtcttgctctctagagaagcccaggcatggatcttataggaaaactttctgactctgcttggccattttatccttttctcctacttctgcccaagagacctgaattgctgccatagaggacagtgtttgtgtggtctcctgagtccacatcgctcgcttccatggggtcccggtgttgtttttgcctcgttccccataggctgctgcccttatggcctctggactgaactctggggcctttggggtggtgtgaaggagtctgtgggcttcttggaacacatggatctgttcggtgggtccccagacctctgctcccagagctcatggcccaggtggtgaggagggaaaggcagtcagattccaggctggagtgtgattctgtgggaatactggggtcagttatggaacaggacttgcccatcataggtaagtgagacagcaaatagatgattcaagagcaaggattactgcgggaaggtgagactcctactgtccacgcgcatgagcagaacctggaaccagaggggcagggaccaggggtctttactcatttattttatgggtaaagagacatgaagagacagcctctctcttctgtctcagaagctctgtgtttgggaaactttgagcccagtgagtagcagggtctgcagtgtgagtaccaggtttccctggcaatccaggtctcctctgaggaagcattctgacttcccactgaccacggaaggcatgtcagcttcatgcctcgggctagagttctgataatcggggctgaggggtgaaaagaaatccagtcagacagacagtggggagacaggtccctgccctttatttgcgggatcaatcagggactcccagaaaggaaggagaatggtgagaagggccctaagagttcgtctctcacctgggggctggtgacgtggtcaccacaagctgaagacaggctaatggggtggcgggtgtgtgtttaaacctcacgtgcctggaagctgcacattgaccaaaggagggagggaagtgctaaccatgtatagagtgggcaggcggttccagggagacaagcagcatgttattaaattgggcctaggcagttggacgataatggagaaaaagcagggatgctataatgagtcctccccaagggtgagttcagcaccccagccctgttctgcttgtatcccagtgatacttgggaggtaggaagaaaatgggagtaagagaacaatttggggctgaagggagtgtcagaggcacgttgatccttgttttgttgtcatggaaacttcggggctggtgggacttaggccaaaagctcagaggcacagccaaaatttagaagcttgctactcctacgactcggcctataaggaagagagaagctgtctgtactttggggactacattgctgaaggaaaaaaatcactccctggctaattaagattgcttccaaattgggggaatgtgtgtcatttcctttaccaaggccagtcatccctgcttccacccatggtcaggacagtcagccactacgtgatgctgtataaattggattacaaaccatattcttgttcagcttgcactaatctatataaataaaatatgtactttgaaaaaaattaggctacatgagtttcaaatggactgtgatgttatagacctgctttctctttggttctgggccagtgtcagacggggacaggggtgataggcctggtgtcctaggggccatttgtgtaccttgaggccgtgttaacatggcctgggggaaagaaagctctcctgtcacttggagtctcattcctaaaccctccttcccagggagcaagtgtggggcagggtttcagagcacaggctttggtgtccagcctgggtacatccagatgtcccgctgtctaactgacattgtgtgagatgcttactctctctgagctccctcctcctggctcccaactttattataaatggggaaaatgattgtgcttgccctacagaattgtagtatgaattaaaagtctggatttaatgtatttaatatagaaaattttagcttttattaataaaagtttttggcatacaagtcaa

SEQ ID NO: 14835 - DNA, 489 bp, Homo sapiens
gcagaggacagctggaaaggaagagctggggcggaggacagctggaaaggaggtacctaatgtgtccttagataacagggtctgaaacccagtgcaagggtctccaaaaccagggtaagaggaggcataaacccagagaccccagcccaggccagagtgaacagtggtacgaggggaacaggatctcccgggttggaacaggggctctcagctctttggcactgcagcagaggggtcgcatctgagtaaaggcagaaacctgggaatgttgggtggggacacatccagtgagagcaaaggaaatggaaaaactaagtctgcagtgatttttggcttctctgcctctttagtgttcactgtctatccttttctccatgggcttatgctcaggatatgtttggagtgaaaggttaaaggggctctggcaccatgcagaggtgtcctagaccagggtctttactcttcattaagagatgaagaggttataag

SEQ ID NO: 14836 - DNA, 7163 bp, Homo sapiens
cacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcaggtggagtttgggtaccgccggcagagagcgggaggggcttgatggtgtagcctcctgggccccaccagaaatccccacttctaatagtctagtgtgatgtgcagtggtcattgcctttgttctgccccagcgcacctgtccgtagcagcagcagtcagtagcagcagcttgagtggcagtggttctcaaacctggaagcgtagcgcagtgtaagctcccaccagccctgagtgagagcttgttggggcacctgggaagggtgtcagcctcagtggtaggcaggcctgagtggaaatcctgattccagcacttatcagctacatgaccttggcaagtgacttcccttttctgagcctgtttccttctctccaggatggcagttattaaaacctactttgcaggtaaatttggtgataatcacaacagctgtcagttacagagtgtttcctatgtgcaagacaccatgctaagcacctcgtgtatattttctcatttcattctcacaacatccctctgagcatccaggcagtctggatccagatctcatgctctttaccactagattgtacaaatataccataggttataagattcctggcacttggtagatgcttgctaagtattggccatcgccccaaccccagccctgttactcttcagccttggagagccaaccatttgttctttcccagcacgtctttctttatgcacttcacagatatgaagttccatgaatgtgaccagtgtaaggagctcttccccacgccagccttgctgcaggttcatgtcaagtgccagcattcaggtcagtacccctgtcagcatacttctaggctagactcggggcctgaatctcccctccaccacttgcagctttgcaacctaggctaaatcgcttaacaaacctgtgcctcggtttcttcatctataaaatgggaacagttgtagcacctgcctcatagagtagtgtgaaaaactgaaggccttggcatcaataagcatcccttaagccgtaactgtgattgtcattgttattgctatactcatcaaatctaaagtgccagttaaaaataaataaatacaattccagttataagatataccatttttattttttttttttttgagacagagtctcactctgtcacccagcctggagtgcagtggtgcgatctcagatcactgcaacctccatctcctgggttcaagcaattctccctgacttagcctcccaagtagctggaattacaggtgcctgccaccatgctcgactaaataagatgtaccttttttttttttttttttttgagatggagtctcactctgtcacccaggctggagtgcagtggcgcgatctcggctcactgcaagctccgtctcccaggttcacgccattctcctgcctcagcctcccgagtagctgggactacaggcgcccaccaccacacccgactaattttttttttgtatttttagtagagacggggtttcatcatgttagccaggatggtctcgatctcctgacctcatgatccgcccgcctcaccctcccaaagtgctgggattacaggcgtgagccactgcgcccagccaagatgtaccatttttaaggaactattaaaaaagaaaaactactgccagttaaactgtgctttcttatcacttagaatttctacgttattctaagtgctgttttggactaatttgacatagatttttatcatgtcactcactctagtgtgcatacatacaaaggaaaacataaaaaaactgattaagggaagaatccagcttctcagagtagtgttcaattcagattgtcaacaagcatgtttttccacacagtgtttactctgccatcaagaacattgatgatggaacgcataatataagattccatcaagaattgaaggccattcgttttggtctcttgagcgttatgtaaaactagtctacttttgattcctgctttgggaatatagctaacctttcatcacttacttcctcccttctaaaccatttggtttccatgagttaaaaacgtgcaccattcctgtcttagggagtttcttccaagccgtggatgcccattctgcaagtcttgatgctgccacttttgatgttggtgtgcgcattgacgattgcacctgactgccttagcccacagaagtcataaggtgccattgatcctacttcagagatgttaaaatgtatttcttagaattgatgaaatatagtatcgtcagcatctttatctgcagttgaatgaataatgggcttctgcagaggcagatttggcctgaatctgatactaatgaaactgtcatctcagggcccctcacttgcatggacccttccaaggctctgtccttgtcattttgtattatttttcttaaggccccccagattgaataacgttcgtgtcccacaaaatgtggatccgcctccaagcctcgatcctcattgctctttcctctcatgtcttcctgccctcatttctctcattttacccagagaattttacccacagccctccccttctgtctccctctcctccagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgattctggggccatcagctacattagaatgctaatgcatggttcctaaggcttctctagaggtggctctgtcatagtacccagagatactctttggggatcttgtagagagtctctctggacttcttacaaaacagaacagaaaattctagtctcctggtggccacatgggaagtggcccttaggtagagggagcctggaacaataatttccaaaagaggaacagcttggttcctcctcccagtgcatacgtccctgcctcctgagaaacaccgtggggtgtggtgagaactgcgggaaacctcggagacagaggaacactttgttgggcagggactgcctgcagttgaagtgcttggagagcgcctctgggcaggacacagtacacacttgcacacacctgggcctctcacctttacctgggcaaaaaaaccacctcttcttgatgcttcagggctaagcttgatccagcttccctttgcttcccagatcctcttttactcttcttcccatcttctccagagagggtgggcagaaaaggaaaataaattcaggtccatccatcgtcagtaatttgtgggtgggttggagaggaaccataaactgattgaggttttggtctgttagactgtcccgctgtccagttccagatcagtcatttataaaccaggttcttacaggcctctggggaacagaggggaagtcaggtaggcaggactcccgccaacactctgctgtcatatcaaccaaaggtgctctgcttttatcttttttgtatattatggttcttgataatatgtcctttggggaaaaggtggggctggggcgtccatttctaaaagaaaaagaaagaaaagcagtttgaaaactactatcctggatcattgttgattgaacatcacagttgatctcttctctcctgtagcacggagaagtagctgggcttggcttcctcacttgttcctgctctctgctcttcactgattctcaagagcaaggtggctgtggcctctagtttaaaaatatcaagggcatctagctcttctgggatctatgggttagaaacatcaactgggaggcttaggcgggaattggatatgcctaaccacagactcattctctctcagttggaaaggtggtctctaacagattatgcagatttggaagggacataggtgggctgtggaggagagaagggggcactggccccgccaggctggtgagctgaatgaatgcgtggagtcacagttcatccagtcttcctcctaagctcggtcactgtgtggcctcctgggaaggctgtgagcctgcgagaggtccagagaggctgccccgggcccacctgggcctgtggtggatcaatcccattcccatgttccaggcatgagaccagctggcttcagtggcattcctctcacatggcactcacctctgcagtgtcatcccaagacaggaaagcccagtgtgaaaaacagagccagtgttcgctggtgtataatcatagagtccgggcgccccgagatggcgtactgagcaaaattatagcaatttagtgcacagttatttaaattgtttgctggccttctcttttgcatcgccagtgggttagacttgcctcttcccattaggcacatgtaagtgctctcctcaggtgaaaacataaatatcatcattacagcatgagatgaaaaccatgtaaatcagggagccaactgtgaacactgcccagagcagcctcacggtctttctctttcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagcca

SEQ ID NO: 14837 - DNA, 7161 bp, Homo sapiens
cacaatcgaacccaccaccctgacgtatttgctgctcagaaccaccgatcttccaagttctcatcactccagtgcagctcctgtgacaaaaccttccccaacaccattgagcacaagaagcacatcaaagcagaacatgcaggtggagtttgggtaccgccggcagagagcgggaggggcttgatggtgtagcctcctgggccccaccagaaatccccacttctaatagtctagtgtgatgtgcagtggtcattgcctttgttctgccccagcgcacctgtccgtagcagcagcagtcagtagcagcagcttgagtggcagtggttctcaaacctggaagcgtagcgcagtgtaagctcccaccagccctgagtgagagcttgttggggcacctgggaagggtgtcagcctcagtggtaggcaggcctgagtggaaatcctgattccagcacttatcagctacatgaccttggcaagtgacttcccttttctgagcctgtttccttctctccaggatggcagttattaaaacctactttgcaggtaaatttggtgataatcacaacagctgtcagttacagagtgtttcctatgtgcaagacaccatgctaagcacctcgtgtatattttctcatttcattctcacaacatccctctgagcatccaggcagtctggatccagatctcatgctctttaccactagattgtacaaatataccataggttataagattcctggcacttggtagatgcttgctaagtattggccatcgccccaaccccagccctgttactcttcagccttggagagccaaccatttgttctttcccagcacgtctttctttatgcacttcacagatatgaagttccatgaatgtgaccagtgtaaggagctcttccccacgccagccttgctgcaggttcatgtcaagtgccagcattcaggtcagtacccctgtcagcatacttctaggctagactcggggcctgaatctcccctccaccacttgcagctttgcaacctaggctaaatcgcttaacaaacctgtgcctcggtttcttcatctataaaatgggaacagttgtagcacctgcctcatagagtagtgtgaaaaactgaaggccttggcatcaataagcatcccttaagccgtaactgtgattgtcattgttattgctatactcatcaaatctaaagtgccagttaaaaataaataaatacaattccagttataagatataccatttttttttttttttttttttgagacagagtctcactctgtcacccagcctggagtgcagtggtgcgatctcagatcactgcaacctccatctcctgggttcaagcaattctccctgacttagcctcccaagtagctggaattacaggtgcctgccaccatgctcgactaaataagatgtacctttttattttttttttttttgagatggagtctcactctgtcacccaggctggagtgcagtggcgtgatctcggctcactgcaacctccgcctcccaggttcaagcgattcttctgcctcagcctcccgagtagctgggactacaggcgtgcaccaccacacccggctaattttttgtatttttagtagagagggggtttcaccatgttggccaggctggtctcaaactcctgacctcatgatccgcccacctcgccctcccaaagtgctgggattacaggcgtgagccactgcgcccagccaagatgtaccacttttaaggaactattaaaaaagaaaaactactgccagttaaactgtgctttcttatcacttagaatttctacgttattctaagtgctgttttggactaatttgacatagatttttatcatgtcactcactctagtgtgcatacatacaaaggaaaacataaaaaaactgattaagggaagaatccagcttctcagagtagtgttcaattcagattgtcaacaagcatgtttttccacacagtgtttactctgccatcaagaacattgatgatggaacgcataatataagattccatcaagaattgaaggccattcgttttggtctcttgagcgttatgtaaaactagtctacttttgattcctgctttgggaatatagctaacctttcatcacttacttcctcccttctaaaccatttggtttccatgagttaaaaacgtgcaccattcctgtcttagggagtttcttccaagccgtggatgcccattctgcaagtcttgatgctgccacttttgatgttggtgtgcgcattgacgattgcacctgactgccttagcccacagaagtcataaggtgccattgatcctacttcagagatgttaaaatgtatttcttagaattgatgaaatatagtatcgtcagcatctttatctgcagttgaatgaataatgggcttctgcagaggcagatttggcctgaatctgatactaatgaaactgtcatctcagggcccctcacttgcatggacccttccaaggctctgtccttgtcattttgtattatttttcttaaggccccccagattgaataacgttcgtgtcccacaaaatgtggatccgcctccaagcctcgatcctcattgctctttcctctcatgtcttcctgccctcatttctctcattttacccagagaattttacccacagccctccccttctgtctccctctcctccagggtcccagccattccggtgcttgtactgtgctgctactttccgttttcctggagcattgcagcaccatgtcaccacggagcacttcaagcagtcagagaccaccttcccctgtgagctctgtggggaactcttcacctcccaggcccagcttgacagtcacctggaatctgagcacccaaaggtgatgagcacggaaacccaggccgcagcctcacagatggcgcaggtgattctggggccatcagctacattagaatgctaatgcatggttcctaaggcttctctagaggtggctctgtcatagtacccagagatactctttggggatcttgtagagagtctctctggacttcttacaaaacagaacagaaaattctagtctcctggtggccacatgggaagtggcccttaggtagagggagcctggaacaataatttccaaaagaggaacagcttggttcctcctcccagtgcatacgtccctgcctcctgagaaacaccgtggggtgtggtgagaactgcgggaaacctcggagacagaggaacactttgttgggcagggactgcctgcagttgaagtgcttggagagcgcctctgggcaggacacagtacacacttgcacacacctgggcctctcacctttacctgggcaaaaaaaccacctcttcttgatgcttcagggctaagcttgatccagcttccctttgcttcccagatcctcttttactcttcttcccatcttctccagagagggtgggcagaaaaggaaaataaattcaggtccatccatcgtcagtaatttgtgggtgggttggagaggaaccataaactgattgaggttttggtctgttagactgtcccgctgtccagttccagatcagtcatttataaaccaggttcttacaggcctctggggaacagaggggaagtcaggtaggcaggactcccgccaacactctgctgtcatatcaaccaaaggtgctctgcttttatcttttttgtatattatggttcttgataatatgtcctttggggaaaaggtggggctggggcgtccatttctaaaagaaaaagaaagaaaagcagtttgaaaactactatcctggatcattgttgattgaacatcacagttgatctcttctctcctgtagcacggagaagtagctgggcttggcttcctcacttgttcctgctctctgctcttcactgattctcaagagcaaggtggctgtggcctctagtttaaaaatatcaagggcatctagctcttctgggatctatgggttagaaacatcaactgggaggcttaggcgggaattggatatgcctaaccacagactcattctctctcagttggaaaggtggtctctaacagattatgcagatttggaagggacataggtgggctgtggaggagagaagggggcactggccccgccaggctggtgagctgaatgaatgcgtggagtcacagttcatccagtcttcctcctaagctcggtcactgtgtggcctcctgggaaggctgtgagcctgcgagaggtccagagaggctgccccgggcccacctgggcctgtggtggatcaatcccattcccatgttccaggcatgagaccagctggcttcagtggcattcctctcacatggcactcacctctgcagtgtcatcccaagacaggaaagcccagtgtgaaaaacagagccagtgttcgctgggtgtataatcatagagtccgggcgccccgagatggcgtactgagcaaaattatagcaatttagtgcacagttatttaaattgtttgctggccttctcttttgcatcgccagtgggttagacttgcctcttcccattaggcacatgtaagtgctctcctcaggtgaaaacataaatatcatcattacagcatgagatgaaaaccatgtaaatcagggagccaactgtgaacactgcccagagcagcctcacggtctttctctttcaggtgatccaaaccccagagccggtggccccgacagagcaggtgatcactttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagcca

SEQ ID NO: 14838 - DNA, 2432 bp, Homo sapiens
ctttggaggagacccagcttgccgggtcgcaggtgtttgtgacgttgccagattctcaggcatctcaggccagctctgagctcgtggcggtgactgtggaggacttgctggatggcacagtgacgctgatctgtggtgaggccaaatgagcagcctttcatccggcagagccttcctgcgtttgcagcagagaggaggccccacagcttgccctttgccctccatccctggctgtcctgagtggtgagcatcttagcttagcaccaaccaacacagtctcacctagaaaacagatggaagcttcgttgttctcatagaaccaacagcatctgagccctcaacaccaacagcaccatcctctgtagcagacaggcctccctccccacaggcccgctgctgcggcctctatgacactgtccatccccaagtgacatgtggcttcagaagtagagtctgaaagagcagtgggatgggagctggtgaccagggtaccccaggaggcatgatgtgccgacagcgctcagtgggcagaatggcagttagatatgggacttggcccacagtgggggctgcaaatgctgccactgcctctggccatttaaagtgagaggggcaccaacagacaattcggggaccttaggccccttcctgaggcacacttggccccttcctcggtcctatcatcctaccctctgctggggttccccctccacccagtggccacgcccagcaccctattgatggctataggacaggtagccctcatttccatgcctgataaccccttgtcagttgtcagctcttcccaaaacaaagctctggagtttctgctggaagtgtttaatgtgaggcatcagctgctagacagtgtctgcctttccaggacattcttcttggtattccttacctgaagcctggttcccacagctcttccgtgtcatcttcatccccttcctttaatcaaaggctgaaatctctgcctgacctggcagcctggctccctctgggtcatatggtgcagactgtgaccagcaccaggcaggcagtcctgtctgcgtgtggaggagcagccgtgactgcccgtggctctgctgccgcccactccctgccttgtgagtggcctgctgcctcacctcccgcaggccgccacacttattgcaggtcagtgatcctttggagtttgaatttcacaaagctttttttatcttcagttcctaaaatataatctgataattaatggtttgtggaatccattatgaagtgcaattagatagatgtaggttcctgccgtttggagagaatgactagcatttatcttcttttccttccatgccaaaggttggagtctgctggtgcggtgtttacacaccaggcagggctgtctgccaccttgtgtggcttgaccccctgtggaggggagtgcctggttggatcccacactggcagagatggggccaccccttccttccaggcacatctcacattgccatgtacagaggcaggagtcacgtttggtcaccatggaagcttttattgctcccacatggtcaggtctcaccctgcttgaagcgcagaaggcacagccttactgaccagcacgcccactgactggcatctgccggctttgtgcaggcagccccgacggtttccacagcgagcgccagctccggccagcctgggacagctcatcccagccgactacacctgcttctggtcctgtccacattttgatacgcagatcacttgagcttgtcaattagggttctgccattctgaaataaatgaagtttctaaagcagagtcggcctcagaagccaaaaactgaccagaagatggtgctcaaacctttaagacttcatctccatgtgaagggctcactgtttctaccaaggctgtgcctgtattaaggcttttccgtcctgggaactgtcagtctgggagagctcttgatctgcaggtggcaaaatggcactgaatatccccttggcagcagagaaaacccactgaaagatcgtagagtggcacatgcttacagggcattggtgccaagtccagtggatgagaatccagcccctcacaagctgtgggatggggcttgggagttgcagtgaatgtcattaaaatttcttccaaaacaaaactagaaataattgctgagggcttatagggaagtgatttaaaaagaaaaaacaaacaacaacaaaaaaaactcttcggaataaagagggctgtaaattttgaattccagtgtcagatcctttcaagcactgagaaattctttctcaggtttctttttttgggggagacagggtcttgctctgtcacccagactggaacacagtggcacgatcttggctcactgcaacctctgcgggctcacgcaatcctcctgccacagcttcccaagtagctgggaccacaggcgtgagcca

SEQ ID NO: 14839 - DNA, 80 bp, Homo sapiens
aaaaaaaaaaaaaaaaaaaaaaaaaaaaaaaaaagaaaaaaaaaaaaaaaaaaagaaaacagaaaagaaaaaaaaaaatc

SEQ ID NO: 14840 - DNA, 6388 bp, Homo sapiens
ccggcacccttaccccgccctcgccatgaacgcctcgatgtccaggtgagtcccggggctggggctgtccgcatgtttgtcttagcaaccacgccatttctgaccacgaaacagctttttcttgccagttaatgagcaggcacagggctcaccctccccccaactctctttgatcaagcatcttctcacgtcccgcgctccccacccccaggtcagaatggagaccacaggatcactgtccccatctctccaacagaaggattgcaaagccctagcactctgcctcctgccatgggctctggcactgaagcattttgaggacagatgctccccgacttaggatggagccgcgtcctgataaacccgtcgtacattgaaaacacaactttcaccttagaatatttgcaacatatgatggttttatccagacataaccccatctaggtcaaggagagtactgaattaatatcgtttttgcaccatcgtaaagtcaaaatatcctaagtcacggactgtctgtatatcacactgaagctagggactgggagaagatgaatttttcctgaaatgatgtcaggagaggagacggtgaaaggggatttctgtctcagggaccagctctacctgacagtggaacctctgaggacagaggaaagctgcccacagcctaagcccttcttttccccagtatgcccgggcctctgaccctcctccccttttgtgtgtttcatcccacctgcttccagcaccagatgggcagcctgggtgttggtggggagaaggaagaggcattaagcatctcccaaacctggttttctagaagacgacaaatagccttctagtcctgagactctgccccacggacatgcctgtgcccttaaggcagagagccaccgtgtcctctgctgggtggcaggtatccagcctgaacccctctgttgccatttgtttctatccggtgcacagcctggtctccagtcggttctctcctcacatggtggctcctgcccaccctggcctgcccacctcagggatcccccaccctgccatcgtctcccccatcgtcaagcaggaaccggcaccccccagcctgagccctgcagtgagcgtgtaagtaagcggcagcctggattcaggtgggagggtgcaggctgtggggaggggtggccacactctgagcagcaaatgtcatgtactcttctctcttggtgtcactcagcaggcatcacagcctccccagccaggccctccctcttcctcgggacttactccctctgaccttctgggtccctgtcctttcagggacatggtgcatcttctctcttattaaggaaagttttactgtcaggtctcagaggctgaaagagaacctgagaaagcttttaacaccccaccgtaagatatatgaaaaggtgaggcccagaaaggagacagtgttttcttaaggacttgtggtgggctggtggccgagctgagatgagcaccagggtccttaccttgcccgtgtaccataaagatggcaggaagccaaagtcagtgctccctggagatcccaagagaaccccctcccaacttggttctgcccagagtgccccacactgtgtcctgtcaccgccgccagcacctgccagctccagtgagagctcatctcagcaaccccaccatgctctgttcctctgtcaggaaattggagagtagattttcaaagaatctggcgtggagatcgttcaaaggtgggaaactacgggaggaaggtactcaggtgttgagtgcagccatggggccacttgaattagcatccaggcagcccgcgcccctccccagagacaatcagcggtgtttcagtgacaggtggggattgatgagttgtgtgacacctgacatgctaacctacaaccacgtgccttcccaggaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattaaccagatccttggaagaaaggtaagacctgccctctccctccaggccagggaggcagcgtccctgcattgatggctccgtgtggtctctgaccctctctcccccagtggcacaacctgtctcgagaagaacaggccaagtactacgagctggcccggaaggagcggcagcttcactcgcagctctacccaacctggtcagcccgggacaactatgtaagtgcacactctgggcagaggacgctcagaccccaggaacagcctctgcaagaggaggaagggtgaaggaaagcaactgcatttatttttatttattttattttcttttattttttgagacagaggctcaccctgtcacccaggctggagtgcatgcagtggcgcgatctcggctcactgcaagctccgcctccccggttcacaccattctcctgtctcagcctcccgagtagctgggactacaggcacctgccaccacacccggctaattttttgtatttttagtagagacggggtttcactgtgttaaccaggatggtctcgagctcctgacctcgtgatccgcccacctcggcctcccaaagcgctgggattacaggcgtgagccaccgcgcccggccagcgactgcatttatagaggactcttaagatcagggagaagcccatacttctctagaaataaggaaggtgttttaattctcaggaggtcaacaagtcctgaggacggacttcagttgatgcatttccctttgaactggactctgccctcgatttcataacacagggcacggggttagctgtggtaggaagagttgtctccagccactcctaacccaacccagggctcaaagaccagtgtgtgagcctcagggggcgtgtctctaagctcccggaaaccaagccaattttcgcatgcgtgttcttctttgctttttttctggtaagaggacccacagttgcatcaaactttcaaagggacctgggacccctcagaaaagatctagaagcactgttctagggagagaaacagaaaaacagagtctgaagggcagtggagggaggaggccttccaagaaggcctggacacccgacctggaggggaaacgcgtttgtaggggaggaagggctccctctgtcctctcacgggctcccacggctgtgatctgaattatctctccacactctccctgagggatcgagagcagtaaagggcaacgtcctgtcttctctctgatctgggagcccctgagaagccagcattcttctctcccagcttacctcttcctttggctgtattttccagggtaagaaaaagaagaggaagagagaaaagcagctgtcccagacacagtcacagcagcaagtccaggaggcagagggtgcgtctcggggcactggcctcttctcctgcttttccttttgtcacagccacacctgcccatgctgtctctagctccctgatgggtcagggcttctgcctcggtattcgcgggcgggtattattacccctttctcgaggtggccacttaagaggctctgagatgtgaaggcattttcccaggcactctgcttcagtggtggtggtaggatttgatcccaggactttgtcacttcaaagcctagacaatctaattccattgaaaagtgaatcatcctacctgagggttaatggaatgaggttgaaattgtctttgaaatacccttaggaaggcagcacatgagcccctgacatcccacctgtcagtggatccaggggagcccgggtttccttggatgtttctttggttgaacaccagaaaaaattagtttgcttgggtttaggaggcactttgtgtcaaaaccatgtataaaatctctatattaccagaatcatgcctagcacagaaagatgctcacactgtgacgattattattaatatttaggtcacgccccccatctcatgctcactccaggacaagtgtatcgctgcttgcacgatgtaaagtgctttcaatctctcttcttcattcctccctccctccctttcttcctccctccctttcaccttccctcccattctccttccctccctttccccttccctccctccttttctccctccctttctctttccctccctctctttccctccctctccccctccttccctcccttccccccctccctttcttcttccctcgctttctccttccgccctccctttctccttccctccctccctatttccttgcctcccctcctcccttccttccttccttccattatacataggagcgcacatgagtggaacccgtacctgctacagaacccgctgtctggcacgctgttcagcaggcatgcactctctctgactgtattaataccataaaccaaagatttcaaagcaaactggagattcatcccaaaagttaccagctttaggaaaggagggtggtcctgtgagacactgagccgtcttctctccgatctgatgctgggtggatcttcatcagtttgggcgttgcctcttctctgtgctctgggtatttgtgaatgcagtttcctagtcttgaaagccttggaagtaatgtcaggtcctcgccaaaatcatccctgtgtctccaaagcacatgtatcgccagggctgttcctcagcctcctcctctcacagagctatagctgctcactctttcttgtattttccccctaggtgccctggcctccaagagcaagaagccatgtgttcagtacctgccccccgagaagccctgtgacagccctgcctcctcccacgggagcatgctggactccccggccactccctctgcagctttggcctcaccagctgcccctgctgccacccattcggagcaagcccagcccctctccctcaccaccaaaccagaaacccgggcccagctggctctccactctgccgccttcctgtcggctaaggctgcagcctcctcctctgggcagatgggcagccagcctcccctcctgtcccggcccctcccccttgggtccatgcccacagctctgctggcctctcccccgtccttccccgccacgctccatgcccaccaggccctcccggtgctacaggcccagcctctttccctggtcaccaagtctgcccactaagctccccccgacccctgcaggctgtcacatgactcattgagtagtaatgattcagaagaaaaagaaaaaggagactttattggtcaatatttgaccactctggactgttctgtaaagtggctggtaacaacagcactttacagtttgtagatgtaaccagtagctgatcttaaggcttttttaaaaaacaaaacaaaacaacaaaaaaaaatctttataagaaagagaactgaaaagtagcgtgctattcgtcctgtaggtgctgtggtggatggacctgggcagagggcacttctctctcttacctctcttgcactttctgtctcctgtctcttctcgcccctgccgcctgccccagcttccccgactccatctgcagctctgccattgtgacatttcctgttacccagcccaagttttcatcgtctgctcaataccgtgggttcttcttcgtcctctgtcctctgcccagtgtgaggccatcaccatgtgagaagacatcttggcctgatttgctgccaccagcgtcccctccctcagtgggcccgaactcgccagccccagctttcagtggagaaagcggtcctctgaaatggtttcctcccaacccccgcatttaaagggactcaaggtgcctgccacttcctcagcgaagaagtctgtgttcctccccgtccttgccagtggcgatcatcccttcacaatcccagagtggcaggcgggaccagccccatggtctggctcctgtcacctgggtccgtgccagcacaatctgccaaagttctagagaccctgttcccttccccatcacctcacatgcttcttctgtgtgtatttctttttgtttttatggtttttggagcaatttaaactcccagttgtttattttcacaaaagaaaataaaattgcagttgcaagaccttttctgagtgtttctttagtgcttttgttgaatcaaaccacctgtttgtttcactcccaaaccctgtgttagactttcgcagatatgcaaaggaagattgccacttgccacaggggaatgttaggcatgcctgacacccttagaaaacctgaacccagcttcctgtctcaaatgtgcatgggccagtcagtgtccatgactgagctgcaaagggggtaatcattttcacagctgatttaaatgaatttgccgcctggaatgacattcagcttatgcttctatcacccattt

SEQ ID NO: 14841 - DNA, 77 bp, Homo sapiens; identical to SEQ ID NO: 7321

SEQ ID NO: 14842 - DNA, 386 bp, Homo sapiens
gagttcaggactagcctgggcaacatagcaagacctgatctctttaaaaaaaaaaaaaaaaagcaactagctggggatggtggcacacaagcctgtagtcccagcttctcaggaggctgaggcaggaggattgcttgagctcaggagctcaagactgcagtgagttatgattgtgccactgcattccagccttctcaacagagtaagactctgcctcaaacaaaaaaggtatacaattcaggctgggtgcgatggctcacacctgtaatcctagcactttgggaggccgaggcgggtggatcacctgaggtcaggagttcgagaccagcctggccaacatggcgaaaccccgtctctactaaaaatacaaaaattagccaggcatg

SEQ ID NO: 14843 - DNA, 1855 bp, Homo sapiens
caaagaggaatatagccatttggagttgtagcccttgggttacctccaaatcatcttttttacaaatctcttttttttttttttgaaatggaatcttgctctgtcacccaggctggagtgcagtggcacgatctcggctcactgcagcctctgcctcctgggttccagcaattctcctgcctcagcctcctgggtagctgggactataggcacacgccaccatgcccggctaatttttgtatttttagtagagacagggtttcaccatgtcggccaggctagtctcgaactcctgacttcaggtgttctgcccgccttggcctcccaaaatgctgggattacaggcatgagtcatcgtgcccggccacaaatctcttttaaaaagaaatctcttctccacttgtaactcacttatcttattatcaaaaaacataatttctgtcctttctctgtgacagataagttttacgttttgagaaggttctgggagagacaggttgtacaagagaaaacattcttgtttattagagccataaacagctgatatgaatcccagctctgccacttactaaccgtgtcccaggctaagtcatgtaatctttctgggctgttccctcatctctggaatgggggtaatcacagcttcttttctaggttataaggagtagaaattatgcctggtgctgtgtttgtaatgcagggttcagtgacctgtagatgtttttaaaataaaaagccttatggataagtcagattaggtttaaacaattaaaaagttaattctgtttaccaattgtagaacgcacaggtttttcccatgttaacatctctgaagatgtgtctgtggcgtgccagcgtttttctcaatagctttataaaataatggtgctccttccatttggtggtgttttacacagaatgtggtagtgaggtcagcagagtaaagtgttacagagagaagtgtttcaagtgctttagggttgtgtctgtaaagcctgaatatgagacttggtagtatgaggtctaatgggggcaactctccccctgccctgttcccagtcccagacttgaacctgagagcaactgtttctatgaagtttatttgaaaaatgtgtgttaaaccttttcagggccgggcgcagtggttcacacctgtaatcccagcaccttgggaggccgaggcgggtggatcacctgaggtcaggagttcaagaccagcctggcccacatggtgaaaccctatctgtactaaaaatacaaaaaaattagccaggcgtgatggcagacgcctgtaatcccagctactccagaggctgagacaggagaattgctggaatccgggaggcagaggctgcagtgagccgagatcatgctactgcactccagcctgggtgacagagcaagactccatctcaaaaaacaaaacaaaacaaaaaaaaaacctttttagattcaatgagatgacacagcgcagatcatccctcagcagcctgtagtgtttgagatgacacagcgcagatcattccccagaagcctgtactgtttcccacacacagtgcacgtgaggggagcgatggagggtgggtgtgatcccttctcaagtcctgctgctctgctgtgtccactgctgtcatctctcagggactgttttgaggactgaatgggatgttgcctggaaaatacctggcacttacttgattccataaataacagctggtcatactctccatctccttggcaaccattcctggtcttttttgtctctttcagtctaataaagttcctgtcgttcagcacccgcatcacatgcatccgctgactcccctcatcacctacagcaatgaccacttctccc

SEQ ID NO: 14844 - DNA, 8056 bp, Homo sapiens
agcggcctgcagtgggaagctggagcagcacacggagcggcgtggggtcatctacagcccggcctggcccctcaactacccgccaggcaccaactgcagctggtacatccagggcgaccgtggtgacatgattaccatcaggtaggggcacccgggggtgtcggaaggaatcaatgtgggcccacgtgcatggggtgggtgagaatgtgtgtgtgtgagcaggtgtggagggcacacgcctgagggtgtacatgtgtgtgagcaggtgtgggatcatgtgcatgtgtgtgagcatatgagtgaggcgtgtgtgagcactcgtgtgaacaggtgtatgggtgtgtgcatgtgtgtgagcatttgtgagtaggtgtgtgtgcatgcagatgtgtgtgtgtgaggtaggcgtgtgtaggtatttgagcaggtatgtggtgtgtgcatgcatgtgaacacatgtaagtaggtgtgtgtgcatatgtgtgtgtgtgcatgtatgtgaacacatgtgtgcttgtgtacatggaaaagcccatgtcggagaagacataaaggacacatgtgagagactgcatgtgtgagcacatgtatgtgcacgagccatgcctgcaaaggtgcagagagcgtgtatgtgcgcatgcatgtaagataacaggtgtaaccatgtgtgaaccgtaagcatgtatgtgcacatgtgaatgcatgcacgcaagtgtgtccagtgctctgggtctccacgggcctctgtggcgaggtgcccaagctggacctcttcctggtttgagcctcgttcatggggtgtggggggtctcagtcactcagctctgccaggaaggcagggccagcacacaggccactgggaacacagcctgggactggtgggcatggtctgatgtctctgaggtggcagaggtgtcctctctgtcctgcaggggtggctgggggccaggctggcactgagcccagagcatggtttctggagggggccttggggaggggagtgaatcaggcaaagcccgggtgcttgagctgcagggacatgcagagggaaagggggccaggcagtgagcggtggtcctggccaggggtggtcacagggacatttggctggggagtcactataggttccatctgccatagttttcctaaatgccagagcccaaaaagcgcaacccctgacttactccatagctgcaatgcgtgaggatgtgatgggcatgggcagggtctatcctagtctctgtgcctcagtttccccaagggccaggtggttcagggccagtgtatctccggagatgacaagctgtcaacctgctgcagccttagccagccccgtgggcagtctcaccctcacttcccatgcctgggactttgtgctgggcccatcccagtggtcccgaggtggagggttctgggcccttgggccactgcccttttggggagggtgtcggggcagggggctcttgacttcctgctccacttcggcttcgggctgggggtactgtgtgcactgatggagggaaggggagccgcagcagagctggaaatgacctgcgtggatgtcgcaattcttcatggagcctcccgtgcacacctggatggggacagtgtggggacagagtggctgggagtggaggaaccaggcagtctggaacatgaggagtgggggcagccggccgggacagggctggctgtcctggccgtggctccagcctgaccactccctgctggtcctcggccatggagatcccacctactgcctcatgtctgggtcctctccgcccccccgcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgaggtgatggaggctgcagggcaggcaggacaccacggagcacaccgtgcatgcccacaggctcccggcccacaggggcggcaccctccacagggccccggctccctgtgggatgtcccctgaccgccctgtcaatctcaggacagtggcaggactgggcatgcggatgccttggacctctcaaggtcactggccccacttcccagtcttggctagtcctgggaactcacccctaaccccaggctcaggtcagggacagagcccaccctggtgttggaggggtctctgctgccacagtgatggggaaccacctgcccgcttttggccccaggccccctggccgaagggaggctcttctgtctcctgactgtcccctgctacgtctccaccccacagggaagctgggccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgccccggggggaccttcccatgcagcggggcgcgctccacgcgctgcctgcctgtggagcggcgctgtgacggcttgcaggactgcggcgacggctcggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcactgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacaggtgggcgctgtgcccgcagccaggggaccgggcttcttcatcacccaggcttgctgtccccgtagctgtgggtttgcaaacgggggcctggactagctacatggaggctgccctggtgcacactggggtccctatatcttggggtgtctgggtggagggtcgtcctggaatcctgttgttgttcctgctgcaggtcccgggcagcccagtcatgtcgccctccgcccactgcttctagggccttcgagacccagatgacgcgcctggaggctgagttcgtgcggcgggaggcacccccatcctatggtcagctcatcgcccagggcctcattccacccgtggaggactttcctgtctacagtgcgtcccaggtgagcccccggagggcgtgaggcccctccggggccacttgggacagtgtgcggaggaggctggtccaggggtcacaggagcaggaggcaaggcctgcgcagggtgacctgagggcccatggccaggtggggggggtggacaaggtggtctctcgggtctcaggtcccttgggggtgtgctgtctcctgcccctgagcagcctgtctgccccctcagccgcatccccccgcccctaccctgctccaccccacaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggtagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcatttctaccctgcctctgcgtcctttcttatggagaggccctccggggaccccagcggaggggctggcccctaagccagctggctgcactggtgggcgggagctgtgggactgaacggcgggggggagaagagtggagtggtgagcccgtctgcagggtcccattgtacacaagcaccctggggtctcacttctctccccccactccattctgggaacccatttccagagaagcaggggaccagagcctttttgcttcatctgccctgcagtggcaacagctgcccctagagctgggagttgtcatgaggatggggccgggccatggggacgctgggtctcatccgtggtgactattttgctcacgcctcaccctcttcctgtccagcaaggcctctggaggacctgggttgggtggctcctgccaaaccctcatgcccctggccaggcaggcgccctttgccctccctgaaggtccaatctcctgggcaccgtggaagggctggggtgtgtgcctgctgtacatgaagcccctggagttccctgcaggcctcaaagcccccaggacatgctgctctgtgctttctggggacagagaggccgaggcaccaacagcagtggccacgtctgttccatcctatctcagggcctcggtttccccacctgtaagccagggtgagactgtgggctctgaagtcctgaccttcactctgtggtgatttacgggaagaaagacaatcccagcctggagcccctgagctctcctgggtggccgagctcagactggcatcgaggggcctggggtaggggcggactgagctgctaccccatcctcgacatccctttagggcagggggactctgggtgccatggtagggagcgcctgtgtcaagcagcaaagccccctaatgtcaagagcctcctccagggcctgccacggcatcttcctggccagcaacatgtgtgcacccaccgaggtacgccccagccactcccatctgtgcccatcagggactccccatagcacgagcgaacagccagccctgtttatttataggccttttcaggaagagctagcagggcagtgctaagacaggaaacccagtccacattttagggcttccttaaacaggcttctgagagtcgtatcttttttcttttttttccagaaaaaaacaaaacaaaacttttttgccaaaacacctcctcaataaacaacatgtaaacagaaacaactgcttcagtctctacaaaaatctcattgtggcttcgagggcttgtctgtggcaggcagcagggagggtgggcaggggccattctcctcctcttcgggggcgtcctgggggtagaccacgaaacacagctcctggccccagtgtgtcatggactctgaggacagacagatggaccttggggcctgacctctcgggataggggtgacccccagctccggacacctccccttgggcaggggtcttcagggagttgctccgtcggtacccgtggttctggaaactttgggtacatcttgggaagagacatttggtggcggctgggccctgtgttcccacctcagctgctaggacaccctgctctggggtgagcctctaagagggaggtctggtctccaggccccggccccctgtgctgggtgacctgcagctgcccggctcacctgtgagtctgtgcacacactttggtttgcttctccagaacactcccagaaagaaaatgggcacccccgtaaggatgatgatgacgccgaccccacagaccataggctctgagatgaagctgaagaccagcaggaaggcccagaagaccaagtacgccacggggatgagaaggttcacctggggaagggggagcagaaacaccgatggtgcagggcctccagctgtctgtacccccgacccctgggggtctggggaattttcctcccttccctgggagctgaggcctgaagggcaattgcacccactacaccccctcttggcgacagcccagtgtgttggaggccaattcatgggtcaggccgttggccagttttgctgaggatttttcaaagtctcagcggcaccgagctccacacagcggttgcgtgtggacttgaggcttgcacttggctggaggtcagtgattttttggtgtttcacatttcaggcactgagcacttctccacttaaggatttatacacacatggggggctttgcttttagctcaggctatggtcttctgtttttgtgtgggctcatgaaatcctggcagcctttgtgaccttgaacagttcctgagtctcattttctttaatttttttttttttttgagacagggtctccctctgtcacccaggttggagtacggtggccctagcaccgctcactgcagcctcaacctcccgggctcaagcgatcctcccatttcagcctctcaagtagctgggaccacaggtgcgcaccaccacaccaggctaacccttttatttttaactttttgcagagaggaagtctcgttatgttgcccaggctggtctcaaactcctgggctccagcaatcctcccacctcggcctcccaaagtgctggaataggcatgagcccctgtgcccagtcctgagcctcattttcgccatctgtacactgggagcattcaaagctctgtcctcatggggctgctatgaggaatggctgcctcagtgcacagagagccctgagcagggcccaacactccacaaaagctggcacctcccatcccacctgcccctggtgcccactgtggatgcaggggtggctctggcagcacccggcacagggccagctgtcccagggcctcaccttgatgggcctgtggagtgcaggccgcctccagcgcagcagcagcaggcccaggatggtgacgccgtagcagaggtagttgatgaaggacacatagttgatgagcgtgtacgtgtcgcccacgagcatgatgacggctgtggccccgcactgggagaggacctggggctgacggctggcccctagcctgcctcctgacgcccctgcaggatgagccctggccccaccccccaacccccaccctggaatggctcacccctgccattacccggaaggtcctgcattgccgggtagccctgcctccacgccctgcctggcccaggtcccccaacttacacagacgaggagggcggggatgggggtgcagtgtctgacgtggatcatggccagcaggctgggcaggtgcccctcgcgggctccagagaagcacagcct

SEQ ID NO: 14845 - DNA, 3540 bp, Homo sapiens
gccgtgcattatccgcaacgctctgcagcactggccggccctccagaagtggtccctcccctatttcaggtgggagctgccctggggtcaggtgtgagcagtgattactggcatctgggcatgggctgagtgtccattcctctagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggtgagtggagtggggtggtcgtggccctggacagggaagatatgggaaggaggggggtcagcctgtttgcccttaggtgatgacctggcctatgggcttggtcctgtcagcatctggtgcagctcactaaatacattcccaggccttgacttaatcatagatgaattgccaaagattgttgtccttccttctgccccagggagggaggaccccttccccaagatttcccaacctctgcctcttctccctgacccctttcttgggattcttctgtgctcacccaggttttggctctggcatcactggatggcagctttccccagcctggccttcctaacttgctctctgccttctgccctgcaggaaagatgcccgatgctgtgaacttctggctgggggaggcggctgcagtgacttcttgtaggtgtaaggggaatacaaaggtggggaaggagcaggttggggcagagggagggaagacgaggccaggagtggagggatggccctgggtggaggttgggctgttctctaagatttcttttggcttctaggactcgggcaccacagagggtttcccctgacagctgaggtcggggaatggacccatggcattgggggcgggtgcattgtttcttctagacccaaagaaacctccctgaaggcccgctgggccagggggtaagtgtaggagaacttcccctcttgttgaagaggagtccagggcctggtgagcatcaggtccctggtaggcagagttccagaatgcccatcagagcccctggcatctccagcccactggctctgtgtgtgcttctcttttgtcataggacgtcttggggtgcagggctctcagcatgatggtttgcctcctcccgtgcccctgccctccataccctgcccccgggccttctttctgttggcagtgcacaaggaccactatgagaacctctactgcgtggtctcaggagagaagcatttcctgttccatccgcccagcgaccggcccttcatcccctatggtaggggatgtggcctgcagggaggggctggggaacagctggcccaagggggagggaggcagcaagagcctgggaggccagttcccaggcctgaggtgtggctgtggcatccccagtgcaccagggcccctgatccccttgcccctgcccagggctggctggggtggaggagggtctggcaagttccaggctgtttgcaattcccccacacccttctcccttgggctccagagctgtacacgccggcaacctaccagctaactgaagagggcacctttaaggtggtggatgaagaggccatggagaaggtgtctgtcctgttcttgggctctagggagggagaagggcagaagcctggctctgaagaacaggcacaaaagatctggggaggtggcaccttgctctgaaaagtctctaagtctgaggcctttcactgctgagccaagcagggcctgtggtgttgacctttggaagggacagagcctgaagtcctgggggggtctggggggctgctccctggcatctgatgtgttcccaggtgccctggatccccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcaggtgaagagttgcccaggccgcctggggagaggccctgtcaaggtccagcagggcctctggggggaggcttgggaggctctaggtcagaagagggatcttcatgctcagatccccgttcttcccacagtgaatttctggtatgacatggaatacgacctcaagtatagttacttccagctgctcgactccctcaccaaggcttcaggccttgactgatggagcactggtgaacaccaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtgagtcgtatgtccttttttttttttttttaagatggggtctcgctctgtcacccaggctggagtgcagtggtgtgatgtcagctcactgcaagctccgcctcccaggttcacactattctgcctcagcctcccaagtagctgggactacaggtgcgtgccaccatgcccggctaatttttttgtatttttagtagagacggggtttcaccgtgttagccagtatggtcttgatctcctgacctcgtgatccacctgcctcggcctcccaaaagtgctgggattacaggtgtgagctgctgcgcctggcttatgagtcgtatgttctgatcctccctcttgaagttgccttctgtggtctaaggagggcctgaaggttcaggtaaaaacttcagggtgaccttcactgggggtgagggctggatcccagcctgggcccaaagagccgtcagctgcccaagtcccgctgtccatgagagtcaccgcagcccctccctgggacaagcaagcagacctgagtcttgtagctctctggtccggacctctttgcccaggaccttgagagctattcctagctctcctatggttactgtcctcccccagttcaggggcagcaggtgggacctgggtgccctggggataacccctgtttctcccataacaggcacaggcaggaagggacggaagcccccgcctctcctggggctgtccctctgaggaaagagttggtctccacacgctgacccccccacaaaccatgccctggaggcagaagaaccccctgcc

SEQ ID NO: 14846 - DNA, 1711 bp, Homo sapiens
agttaatatgtttcttatgggagctgtggtcttctccaggggtagggaggggagtttattgaccacaagaccagggtagcgggcagaagccaggggaggaggaggcttggggatgagggatccgtcctgagtgttttctgtcctgggaacgggctcctggcagagctccctggcaccacagatttgggccctggagactcagaggctcccagctgccgccctgaggccctggaagcaagtggctcctccatgctcctctgactcagttgcctggagtgtgagggccctgggctgaccctggtggatgaggccctccagcactgccctggacctggttgctccctggacttgacctgttagggtccttgtggaggcaggtggaaggccgaaaggaagcagttggcacaggcttccctggtcccggtgcgcctgccaggctgcattcccagaaccaggggcatgggtttggagggagctaccgggggaccatcttcagcctgacctggcaggacctggaggacatgacagcctgtgaggggtctgagctaggagccgcctcccctgcccaggagagagcccatttccaggatgctcttctgaccagggtggagggagggtacgagagcagctcagcctggggcccaaggccctgatgtgctacttcccctccctcgatagcttatgtcccctgccacccaagaccagccggaaagctgcttagctggggtgtgggctggggatgtggggtggagagcctaaaggatactagcccgagaaggtggaagcaggtctgtgtgaggcataaatctggagccagcctgcccgggctccaaccccaattgtggacctcaggcaagtgactgcttctctgtgcctcagtttccttgtggagtgggccatcgtaaatagtatctgtgcataaggtggttgtgcgataaatgagttaatgtatgcaaagcccttggcccagagccggcgcagagcattgtgtaagtgctggcaggcgtcatgatggagatatcatgtctcctcttgttgattcaggattctgatgagatggaggatgggcctggggttcaagattaagcccttgaggcactgctccagcctccttttgtgggcccctgtcacccttggcttcatcggcccgtagcaggtctcccctctcccacctctgcaggcagaggtgtccaggacctgcctgctcacggttcgtgtcctgcaggcccatcgcctaccctctaaggacctaggtgagtgcgcaccgccctggcccctgtgctgggctgagggaggaggagggtgcttaggaggagggtgctgtggctggatttggtggaggcgggtgggccggtgggcagggcctagaggagggagctgagaggagcttctgggtggaaggtggcagctggggctctgcctctggcccccacttcccctccccctcagtcttaacccacatggggctctaggtgatggaaggaagtgggtctgggcggctgggaagggctcttgtccaccgctgggcacttgttccttcccgcagtgaccccctctgactgctacgtgactctctggctgcccacggcctgcagccacaggctccagacacgcacggtcaagaacagcagtagccctgtctggaaccagagctttcacttcaggatccacaggcagctcaaggtgggccaggcatcagcgctgactctac

SEQ ID NO: 14847 - DNA, 38771 bp, Homo sapiens; identical to SEQ ID NO: 6652
  misc_feature (7892)..(9416): n equals a,t,g, or c

SEQ ID NO: 14848 - DNA, 793 bp, Homo sapiens
cctgtatgtagctccagctacttggaaggctaagatgggaggatggcttgagcccaagagcagagcccgcaatgagtggagatcgtgccactgcattccaggctgggcaacagaatgagactctgtctcaaaaaaataaaaaaaaagaaaagataaacagtaaaatggaatcagaggaggaggtaatgccaagagttccactattcattgaaaactaagggagtatgttgtggaaagagaatgacagcagaagctatgttttctttcttaatttttatctgtcttttgattcttttttcaaaatgagtctagatggtctaagcagaggagatcagaagcatcaaaatggggctggtttggggcagtgggtgtttttctcagtgactgttaatctccagaagcatggcagttctagggccagaggctacgtggcttatcctagagggagtaccttcaggtatacaattatgtcttagttgagggttttaaaaaaattgttgtcaccaggtgcagtggctcatgcttgtaatcccagcactttggtaggccgaggtgggtggatcacaaggtcaggagtttgagaccgtcctggctaacacggggaaaccctgtctctactaaaaatacaaaaaaattaggctctggtggcgcgcgcctatagtcccagctactcaggaggctgaggcaggagaatcgcttgaacccaggaggtggaggttgcagtgagcccaaatcgcgccactgcactccagcctgggcgacagagcgagactctgtcaaaaaaaaaaaaaaa

SEQ ID NO: 14849 - DNA, 794 bp, Homo sapiens
cctgtatgtagctccagctacttggaaggctaagatgggaggatggcttgagcccaagaggcagagcccgcaatgagtggagatcgtgccactgcattccaggctgggcaacagaatgagactctgtctcaaaaaaataaaaaaaaagaaaagataaacagtaaaatggaatcagaggaggaggtaatgccaagagttccactattcattgaaaactaagggagtatgttgtggaaagagaatgacagcagaagctatgttttctttcttaatttttatctgtcttttgattcttttttcaaaatgagtctagatggtctaagcagaggagatcagaagcatcaaaatggggctggtttggggcagtgggtgtttttctcagtgactgttaatctccagaagcatggcagttctagggccagaggctacgtggcttatcctagagggagtaccttcaggtatacaattatgtcttagttgagggttttaaaaaaattgttgtcaccaggtgcagtggctcatgcttgtaatcccagcactttggtaggccgaggtgggtggatcacaaggtcaggagtttgagaccgtcctggctaacacggggaaaccctgtctctactaaaaatacaaaaaaattaggctctggtggcgcgcgcctatagtcccagctactcaggaggctgaggcaggagaatcgcttgaacccaggaggtggaggttgcagtgagcccaaatcgcgcctttgcactccagcctgggcgacagagcgagactctgtcaaaaaaaaaaaaaaa

SEQ ID NO: 14850 - DNA, 4710 bp, Homo sapiens
gaaatatatatatgagaaactaaagtcatttcccataacttaaaagaggcatagaatatttcgagttgaatacagtttctgcctggcttgttttcttctgcctcttttttttaaagctcatctttgggtgaaaaattgtcgggatcttctgcagtccagctacaacaaacagcgctttgatcaacctttagaggcttcaacctggctgaagaatttcaaaactacaaatgagcgcttcctgaaccaggtgactagactcccagaagttgagtgctaggtagtccttacatggattctttgtgccctgagtaccaatagactatggagaactgatactggagttggaataactgtatcatttttaatttctttcatacgttttgctcacagtggactcataacttgaaactcatttatccatgtgaaataaataggcaacagtaagttgttcccattttgtgggtagcaaagtgaaatccagttgattcattgacttttcaaggtacagcctccaatccctcgcaagcacatttccaactacatgattttctccagacaatatctttttagggaaccagaaatgtattggaaaaattcttctttaccctggtgattcttagataccctgtctagaccaggggccttcaactctggatataaagcagagtcacctaagagcttgttaaaaatgcagatgccagagtctcattctggacattttcatcagaatcccttatgtatgtttattcaaggctccaagcagaaatggattagaaagcattcactttggtcaggcacaggggctcacacctgtaatgtcagcactttgggaggccaaggcaggcagatcacctgaggtcaggagttcaagatgagcctggccaacatggtgaaatcccatctctactaaaaatacaaatattagccgggtgtggtggtgcacgcctgtaggcccatctattcaggaggctgaggcaggggaatctcttgaacctgggaatcagaggtttcagtgagccgagatagcgccattgtactccagcctgggtaacagagcgagatatggtctcaaaaaaaagataaaagaggtcaggcgtgtggctcagacatgtaattccagcattttgggaggccgaggtgggcagatcacctgaggtcaggaattctagaccagcctggccaacatggcgaaaccccatctctactaaaaatacaaaaattagccaggcgtggtgacacacgcctgaaatcccagctacttgggaggctgaggcaagagaatcccttaaacctgggaggtggatgttgcagcgagctgagatcatgccactgcacttcagcctgggttacagagaaagaagctgtctcaaaaaaaaaaaaaaagaaagaaaagaaagcattcacttctacattgaggtctcttacagaacctgaacaatagattaaaatgaactcctgttaaccttagcctccaaccttttcaagggatggtttcacccttaggccaagtagccttttttttggtttttattttctttgcttgcttttagataaaagttcaagagaagtatgtctggaataagagagaaagcactgagaaagggagtcctctgggagaagtggttgaacaggtataagaaaaaacactgaatgtgtaacatgcgataacaagagaaggcctctggtagcactacaatccactgtctctcccaatagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccggtaggaaaactgggtgtctctatcttgtttctctgatttctgattccatcagtatggaggctgggtcttagccttgtagaccatgcaatatgttttcttgccctaggaatatttgaagataaacagtaaagagctgggtgcagtggctcacgcctgtaatcccattggctcacgaggctgaggtgggaggatcgcttgaggccaggagttcaagactaggatgggcactatagcaaggcccctgcctctaaaaaaataagaaattagccggtagctggcatggtggcacacacctgtagtcactgctactggaaggctgaggccagaggatcacttgagccctggagttcaaggttgtagtgtggcatgattgcaacactgcacaccaacctgggtgacagagtgaaatcctgtctcttaaaaaatatatatatggctgggcacagtggctcatgcctgtaatcccagcacttggggaggctgaggcgggcggatcacctgagcttggagttcgagaccagcctgaccaacatggagaaacccatctctactaaaaatacaaaattagccgggcatggtggtgcatgactgtaatcccagttactcgggaggctgaggcaggagaatcgcttgaacccaggaggcggaggttgcagtgagccgagatcgccatatatatatattcatatatatgtatatatacacacatatatattcatatatgtatatatacacacatatattcatatatatttatatatacatatattcatatgttttcataatatacgaatatacctatatgttcatatatgtatatataatattcatatatgtatatatgtatatataatattcatatatgtatatatgtatatatacgtatatatgcacacatacatattcgtatatgcatatgcacacatacatattcgtatatatatgtgaagataaacagcaaggcctggtgtgatggctgataaatcccagcacttttaggaggccaagaggtgatttgcttgagtccaggagtttggagtttgaggtcagcctgggcagcacagtgaaaccctgtccctacaaaaaatataaaaaactagctgggcatggtggtttgcacctgtatgtagctccagctacttggaaggctaagatgggaggatggcttgagcccaagaggcagagcccgcaatgagtggagatcgtgccactgcattccaggctgggcaacagaatgagactctgtctcaaaaaaataaaaaaaaagaaaagataaacagtaaaatggaatcagaggaggaggtaatgccaagagttccactattcattgaaaactaagggagtatgttgtggaaagagaatgacagcagaagctatgttttctttcttaatttttatctgtcttttgattcttttttcaaaatgagtctagatggtctaagcagaggagatcagaagcatcaaaatggggctggtttggggcagtgggtgtttttctcagtgactgttaatctccagaagcatggcagttctagggccagaggctacgtggcttatcctagagggagtaccttcaggtatacaattatgtcttagttgagggtgttaaaaaaattgttgtcaccaggtgcagtggctcatgcttgtaatcccagcactttggtaggccgaggtgggtggatcacaaggtcaggagtttgagaccgtcctggctaacacgatgaaaccctgtctctactaaaaatacaaaaatagtaggctgtgatggcgtgtgtctgtagtcccagctactcaggaggctgaggcaggagaatcgcttgaacccaggaggtggaggttgcagtgagcccaaatcgcgccactgcactccagcctgggcgacagagcgagactctgtcaaaaaaaaaaaaaaattgttgtcaattgtttcgggagaacatctaggaaaggcacgtgatgatctcttctctctttctgtccgatatgcagattgcccccgaggaattagcacttgttcacaacttgaggaaaatgatgaaaaatgattgggtaagtgcatatgatacctcacacatttcagaaagaaatgtattatcattttaaacatgttctactatttcattgctaatactttacagtctctaattttatggacagtaagttattatgtcttatttaattcctgtatctgtaccaagttagaaataaagtctgaattaaaatctatatatatgtggtttataatctttccaaagtaagtttattcaaaaccattttatttaaatattggcctaattttattttgcttgcagacatttaaagtgtttttgtatctccttaccgtctttggaaaagagtttgagacccacaaatatgtcatggtaaatttaaaatcaggtagcagtttattgtcagagccaaatctggaataaccaatttagttgccatttaactgtgctagaccacacttttgtaacactgtatgcccaagaaagaaaaaaaaaatctacagatgattaatgcagttttccatcctttttaactttttccagttcagccttttctcttttctttcagcatggaggcgccattgtgtcggctttgagccagactgggtctctctttaagccccggaaagcctatctgccccaggagttgctgggaaaggtcaagtcaaaggaaaatttgtttctacttagattgttatcctgtttaaagaaaaatatttttattaatctatgtattttgacataatttcagacttagagaaaaatcatattcctgtatgcccttcccctggattcctaaaatattaacttgatcatcattgcttta

SEQ ID NO: 14851 - DNA, 5775 bp, Homo sapiens; identical to SEQ ID NO: 6656

SEQ ID NO: 14852 - DNA, 738 bp, Homo sapiens; identical to SEQ ID NO: 6657

SEQ ID NO: 14853 - DNA, 852 bp, Homo sapiens
aaggcacgtgatgatctcttctctctttctgtccgatatgcagattgcccccgaggaattagcacttgttcacaacttgaggaaaatgatgaaaaatgattgggtaagtgcatatgatacctcacacatttcagaaagaaatgtattatcattttaaacatgttctactatttcattgctaatactttacagtctctaattttatggacagtaagttattatgtcttatttaattcctgtatctgtaccaagttagaaataaagtctgaattaaaatctatatatatgtggtttataatctttccaaagtaagtttattcaaaaccattttatttaaatattggcctaattttattttgcttgcagacatttaaagtgtttttgtatctccttaccgtctttggaaaagagtttgagacccacaaatatgtcatggtaaatttaaaatcaggtagcagtttattgtcagagccaaatctggaataaccaatttagttgccatttaactgtgctagaccacacttttgtaacactgtatgcccaagaaagaaaaaaaaaatctacagatgattaatgcagttttccatcctttttaactttttccagttcagccttttctcttttctttcagcatggaggcgccattgtgtcggctttgagccagactgggtctctctttaagccccggaaagcctatctgccccaggagttgctgggaaaggtcaagtcaaaggaaaatttgtttctacttagattgttatcctgtttaaagaaaaatatttttattaatctatgtattttgacataatttcagacttagagaaaaatcatattcctgtatgcccttcccct

SEQ ID NO: 14854 - DNA, 634 bp, Homo sapiens
tacatttttagtagagacaggatttcaccatattggccaggctggtcttgaactcctgacctcgtgatccacccgccttggcctcccaaagtgctgggattacagacgtgagccatcacacccggccaatgaaggaatttttaatggccaaatctaagatgatttgagcaccaaaataaaaagtgacagtaatgatttagattctattaaataaaaatccacaagaccataccagctgcggaggctccatgccaggtataactaaagtaatggatactaaaaccagtaggtggaagtttgagaagtaacaggatctttacctagtctcaaagtatatctctacaacatacatattaattccaaagcaaaataataactttactgaagagaaaccagatggacaacacctcagctaacagttccaaaatcattaccagtaatgggagaaatgtgcctcctgataggatgcactcactcagacatgtcatcacttctaacatcacttctattcaggaggaaacctcagacaaccccaaaaagtgacctacaaaatagctggcatgcacatgccaaaaacataaagatttcaaatgacaaagactgacagactgtcacagattaaaggagaccaaag

SEQ ID NO: 14855 - DNA, 852 bp, Homo sapiens; identical to SEQ ID NO: 14853

SEQ ID NO: 14856 - DNA, 127 bp, Homo sapiens
gggtgcggtggctcatgcctgtaatcccagcactttgggaggccgaggcaggcggatcatgaggtcaggagatcgagaccatcctggctaacatggtgaaaccccgtctctactaaaaatacaaaaa

SEQ ID NO: 14857 - DNA, 1189 bp, Homo sapiens
ttttttttttttgagacggagtcttgctctggcaagactggagtgcagtggcgcgatctcggctcactgcaagctccacctcccgggttcacaccattctcctgcctcagcctcccgagtagctgggactacaggcgcccgccaccacgcccagccagttttttgtatttttagtagagctggggtttcaccatgttagccaggatgggctcgatttcctgacctcgttatccacctgccttggcctcccaaagtgctgggattacaggcatgagccattgcacccggcctcagctttactttcctaacagggatctgatagctaaaggaaaagcctttgccagtcacgatggctcaaacctataatcccagcactttgggaggctgaggctggaatattgcttagagcccaggaggaggctgcagtgagctgtgatcgcaccactacactctagcgtgggcaacaaagcaagaccctgtctcaaaaaaaaaaaaaaaaaagaagaagaagaaaagcctttactccagatgtagagcagactgagctcatccatcatgatttcttcgtgatattactgccaagcagattataaggtgaagtcaatgtgacaaaaggaaattcggctaaaagcttcctgaagccttttgatgctaagcagtccttcttttgatatttaatacccatggacataaacttctgccttagaggtcgccatggagttttgttttgttttgttttgttttgtttttgccatctgttaacagtcctgagtacccatagagccttttactatttatcagcattctagagtcgtcagtatggattgtcaaaacttgcatttgtctcttttttgttcagtgttgtgtgcatccacattttctttcttttttaaacaaccctgcttatgtaacatccacattttctgacttacctttcaaacctgccagaaagcagaagtgatatttaatacacttggtatgttttatatattgattctaatgataatgtttagtctaagatggacctgacaaggccaggcatagtggttcaacagcactttgagaggctgaggcaggatgattgcctgagcctaggagttcaaggttacagtgaactgtgatcacatcctgccttctagcctgggtgacagagcaagaccctgtctcaaaaaaaaaaaaaaaaaagaaa

SEQ ID NO: 14858 - DNA, 3222 bp, Homo sapiens
gaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggtttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaagacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatcctttcagggaatatgtgagatcaaaatttttatactggcactatgatgtatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgaaactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccaagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgcttatgttttgactgctcggttaattatttttgagaaatatatgtgttaaagactccatatttctgtacacaactgatacctggtatttgctcattttaaggtctttttagtaatgggcgaagtatagagaaagtagagctggttcatccatcacttgggtcaaaccctccatccttaaacagttgctcatgtgcaggtggacgcatcattgaagcttttctttctttgggcaccagagtcagggatagattcaggccccaaaagaccccacggtacttcctgggcccttgggctctgtcctgaacttctgtgtcctgaaa

SEQ ID NO: 14859 - DNA, 7217 bp, Homo sapiens
ggggtgaggaggagggacagtgtattagagattttactgttcaaaatgtagacttcctcagttttcagtaaaatactctaccctgtctatatgtggattcccctattccagactgattcacccttttcagtgagttagtcgtgacatttcttacactgtgagggggagtggtaattactttacagggaggtatggggccatggtgtttgactcttctttcaaccacttctgggttttttagtgaaaacctctatctaacactgatactttcatttctgttgtctattgagtcagttaacactgatccatttatttttcagttcccaaaatcttgctttgccattgcttctattttattgtctgggggtgtttaacacctgtttcattttttacagtcatttagtttccagattttagtaagggacagaggggaatagatggactcatttcatgatgtagaaacaaatactccctgtcttgtcttacatgaaaaattattcttaaactaggccttatctttgagaacctgatcaaagtataaaaaatactttttggctttatttctttagtgagtcactattccatattttgaaggtgttaagaggtatggtaaaggtggtacttgaacatttccaagcaaacgtgtgatgaaatctttcatcaatgtcttagcaatggtatatgatttttttagtcttagcaattttagataagttttttttttgtcttgtttttttgagacggagtcttgctctgtcgcctaggctacagtgtagtggcgtgatctcggctcactgcagcctctgcctccgagcggggtccagcgattctcctgcatcagcctcctgggtagttgggattacaggtgcatgccaccacacccaactgatttttgtatttttagtagagacagggtttcaccatcttggcctgactggtcccgaactgatctcaggtgatctgcccacctcggcctcccaaagtgctgggattacaagcgtgagccactgcgtggcctgaggtaagattttataagaagcctacaaagccctaatttttacattaagaacattaagtgcttctgatagttttaagttccgtagtctttatttcaaagaattatttcattctgaatttctatttaaattagtctagaatatgtttataaatttatttacatttggttgaaatgtattcttaaaacttattccacagtttccagtttgaggataaatgaggtctaaagacagtatgaacttgttaataatttttcctattgtcctttttagaaatcttacatatcctttagcctaattatagattggccctgcaagcatgtcactgtatcttttatgtcttcctgagtcttagcactttaaattcttctatatccttcactgtctttcttacagcaccctaaaagagtagcatgtgaactgttgctcttctctaaggtattttaggacatttttaaaataatatatgagtggttgtcatgctaaatactgtctaccacaactcatacaattaaagtggtcaaagaaaggtctctttcatttcttttttcattttaaaaagaaatgttatttgtaaaacagtatagtcataacacagatatggcagttttttagtttttttttttctttttcttcactgtgtcatccaggcagtagcgtgattataattcactgcagcctccaactcctgggcttgagggatcctctcactgagccttctgagcagctgggactgcaaacgtgtgccagtactcctggctaatttttaaatttttttgtagaattgaggtgtttttttaaatttttttaaagccttgtttgcaaactgttgcaacttctggcggctgcaacttctggcctcaagcaatcttcctgtcttggcctcccaatagcataagctaccgcacccagcccacaattttctttcagtacaatataaacatcttgcaagcgctagcttgatttacactttttgtctgtatccacctctttttttttttttttttttttttttttttgagatggagtttcgctcttactgcccaggctggagtgcagtggtgcgatcttggctcattgcaacttccacctcccaggttcaagcgattctcctgcctccatcttccgagtaggtggcattacaggcatgtgccaccacgcccggcgagttttgtatttttagtagagatgaggtttctccatgttggtcaggctagtctcgaactcctgacctcaggtgatccacccaccttggcctcccaaagtgctgggattacaggcatgagccactgcgcccagtatatatccaccactttaccatccacattagcatttcattagcttctctttgcccttttagttaataaccccatctcagggtgattcactttcataatccgtattaccatggattaattctgcatagcaaaaactatgataggtgtgttaagtaatgaagtttggggaatgttaataagatgatttctcttactgtagatgaaatacatcgtaagagaatccctcgtgagaccagatcagttacatgtatatcttgcctctcttaagtctctaccatttattactgtacttgagttaggatttggaagtgccactgaacactaaaattattctgtctgggtatttgaatggtgtgagacaaaaatccattttaatgttttatcaagttgagatgtctcacatgagtagttagtgctgagaatcagacacaggcacatttgggagcatggcgtggcaagaagctttgctttttcctgttcctattgtactcaaacttgtttctacatttttcattgatttctcttcgtactagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggtttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaagacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgaaactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccaagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgcttatgttttgactgctcggttaattatttttgagaaatatatgtgttaaagactccatatttctgtacacaactgatacctggtatttgctcattttaaggtctttttagtaatgggcgaagtatagagaaagtagagctggttcatccatcacttgggtcaaaccctccatccttaaacagttgctcatgtgcaggtggacgcatcattgaagcttttctttctttgggcaccagagtcagggatagattcaggccccaaaagaccccacggtacttcctgggcccttgggctctgtcctgaacttctgtgtcctgaaa

SEQ ID NO: 14860 - DNA, 85 bp, Homo sapiens
tttttgtttttttgagacggagtctcactctgtcgcccaggctggagtgcagtggcgcgatcttggttcaccgcaagctccgcct

SEQ ID NO: 14861 - DNA, 85 bp, Homo sapiens; identical to SEQ ID NO: 14860

SEQ ID NO: 14862 - DNA, 32720 bp, Homo sapiens
cagccagtaccttttcaacaaccaaagcacttcactggaggagtgatgcgatggtaccaagtaaaaggcatggaatggcttagggtaatgaattggaatttttaatacaagatactggttttatttctatagtagcctaatgatttgaggtaccacaacttgagtcatttctatcatgtttcactattatacatttgtatgtggatacttgctttctgatttctttaccctgaatttttagaagtagaaattaccttgttaatggcttccagcacttttatggctttgataaaggactttccagtgttgttataatttatggtgtgaatatatcagctttaacataattctcatctttgggtgtgattttttaaagagaagaaataaaatattgtaatcctgtagttgtttatatccaagtttaaatacagtatctattattttgtccagatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatgtaagacatgcttccttatgttaaaattataattttacatgttttcttatgctttgttgtagtaggaattaaattgtagaactcttataattatattggtttctgtataaatattttgtctgatttgacttactcaatctgcacaataccctaatttaaatttatatagtataggttttggaaatccctgacatctttcctaaaatattcctgaatgattttcagtgcattggtaatttgattcgactgagacagacttaggtagagattttattaaaaattctgcttgttcttcacttgatctttgccaaaaggctaagaagagagttttctgttttttctgtacttgttaccttctgcaatttttttttttttttttttttttgaaatggagtctctgttacccaggctggagggcagtgatgcagtcttggttcactgcaatctctgcctcccatgatgaagcaattcttgtgcctgagccaccggagtagctgggattacaagcatgtgccaccatgcccagctaattttatgtttttagtagagacgatgtcttgccatgttggccaggctggtcttgaactcctggcctgaagagatctgcccactttggcctctcaaagtactgggattatagacgtgagccactgtacctcccgggcccagcccttctgcacatttttgccttatgagaaatatatatattctagacgtagtatcaccatctgtctcattttatatatttatatatatattatttatttatttattttgaaatggagtctgtctctgtcaccatgctggagtgtagtagctgggactacaggcgcacaccacaaggccaggctaattttttgtattttggtagagacaggatttcaccatgttggccaagatggcctctatctcctgaccttgtgatccgcccaccttggcctcccacagtggtgggattacaggtgtgagccactgcgcccagcctatatgtgttttatgtatttgtaggttttttgttggggggggggttgtgtttgtgtgtgtgtgtgtgtgtgtgtgtgtgtgtgtgtgtgtgtgtatgacagagtttcactgttgttgcccaggctggagtgcaatggcacgatctcggctcagtgcaacctccgcctcccgggttcaagcgattctcctgtctcagcctcccaggtagctgggattacgggcgtgcgccaccacgcctggctaattttgtatttttagtagtgacggggtttctccatgttggtcaggctggtctggaactcccgacctcaggtggtctgcccgcctcagcttcccaaagtgctggggattacaggtatgagccatcccacctggcccgtctatttgtttttatgcctttttttttgtcttcagacaggatgttgctctgttgctcaggctggagtgcagtggcgtcattctggctcactgtggccttcacctcccaggctcatgtgagcctgctatctcacacgcctgagtagctcatgtgaacctcccatctcactccactgggtgagtagctggcactacgggtgcgtaccaccacaccagctaatttttgtattttttgtagagatgggatttctccatgttgctcaggttgatctcgaactactggactttagagatcggcttgccttggcttcccaaagtgttgagattataggtgtgagccattgtgctgggcctgactttgtttttttgtttgtttttttttcattttctcccataatagttcaatgatttgttagaattgcttggcttattttgctatagaaaaatagaaataaaattttttaaaattatattttttccctcagaatgatttatattttctaaatagtcaatatttacattttgttcttaagtctgataaaaatcaatataaaatttttcagatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacaggtacaaatgatcttcattggtttctttgtaatacataaaacatgcttttcttcatttatatcactttctcaccatctgggagcatttgtctaatttttttttgttgtcgaaataatagattatattgtgcatatacctgtagaagctggaaacttttattaacagaatgattgggatgaaggccatcatttgtaacaatataattaaagcttatggcagtttaacctatggcttagaatcatccagaaatagacctaatctcggaatgtattacagatatatttgtgacaggtactttgaatatatggaatttacttatcgtattttaatcaaataagagtatttgaagacaagttatttttagagtatcttattggactatttggtagcattttcgtttctattttcttgatgttctagctacttatttaaataatttccagttagcataacagaattgaaagattgaccttttttctttcatgccttctgttttcatttattggtgttttgaacttcttcctcactgctctacctcattcatttataattcttgactgctttttttttcctttctctggccatgtgagaaccctcttagtgcagtccccttaggtttatcttgcttgcttggaaataggaaagtatttaatggtttcaacataaaatcaaaacacataagtcataaatagaataattatgacttgcataattatgaccagtattgtcaggttttatgtgtctgctggtaaaactttggaatatgatttgcagaaatctcagttcaggagtttagcaaagtttatgaatgtgtacagcattaaaaagtatttaaaccaggccgggcatgaaggcttatgccagtaattccagcacttgggagtctgaggtgggcagatcccttgaggccaggagttccagaccagcctggccaacatgacgaaaccctgtctccactaaaaatacaaaaattaggccggacgcggtggctcacgcctgtaatcccagcactttgggaggccgaggcgggtggatcatgaggtcaggatatcgagaccatcctggctaacaaggtgaaaccccgtctctactaaaaattacaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggccgacagagcgagactccgtctcaaaaaaaaaaaaaaaaaaaaaaaaaaatacaaaaattagctgggtgtgatggtgcacatgtttaatggcacaaggattgcttaaacccaggaggtggaggttgcagtgagctgtgattgcgccactgcactctagcctgtgctacagtgagagtctgtctcaaaaagaaaaaaaaatttaaaccagtagtccccaaccttttggcaccaggaaccggttttgtggaagacaagttttccatggaccatgggtgggggatggtttcagaatgattcaaatgcattataattattgtgcactttatttttattattataaaattgtcatatataatgaaataatagggctggccgtagtggctcacccctgtaatcccagcactttgggaagcttaggcgggcagatcacttgaggtgaggagtttgagaccatcctggccaagatggtggccaacatggtgaaaccacatctctacaaaaatacaaaaattacctgggcatagtggcctagctccttgggaggctgaggcaggataattgcttgaacccgggaggcggatgttgcagtgagccgagatcatgccgcttggttggctgggcaaccaagtgagactgtgtctcaaaataataataattttacaactcaacataacgtagaatcagtggtagccctgagcttgttttccatctagggatgatgggagacagtgacaaatcatccaccattagatttttataaggagcgcacaacccagacaacccagatcccttggatgtgcagttcacaatagtgttcatgctcctatgagaatataatgtctcctgatctgacgggaggcagagctcaggccataatgtgagcagtggggagtggctgtaaatacagatgaagcttcccttttctgtaaatacagacgaggcttccctcgctcacagctgcttacctcctgctgtgtggcctggttcctaacatgccatggacccctacaggtctgtgacctgggggttggggacccctgatttaaagcatttctttacagtaaaagtaatatataccaattttttttaaagggtagtgtacaggaagatgtaaaagcacctgtaattctacctgagaactactacttttttctttttttttttttttttgaggcagagtcttgctctgttgcccaggctggagttcagtggcgcgatcttagctcactgcaagctccacctcccaggttcacaccattctcctgcctcagcctgccgagtagttgggactacaggtgcccacaaccatgcccggctaatttttttgtatttctagtagagatggggtttctctgtgttagccaggatggtctcgatctcctgccctcgtgatccgcccgcctcagcctcccagagaactactacttttatactaaataattatagctaacatgtaggtataatttacacatatgatcatactatacattcaatttttttttttttggtccgagacagggtctcactttgtcacccaggctggagtcctgtggcacgatctcagctcactgtagcctgaatctcctgggctcaagtgattctcctacctctgtctcctgagtagccgggactacaggcgtccgtcatcacacctgactgattcttgtatttttttgtaggaacagggtgtctcaagccatccaactgtctaggcctcccaaagtgctgggagtacaggtgtgagccaccacttccagcctgcattcacttttgcaacttgtgttttctactcagtagtataacatgaagacccttcctgtaatgaaatagttaagcttccttgtccatttcctttgccagtggctagaaacttttgactttttccatttaagtgagcttatattatcatttcaaggatcttagcttactctggtaacggagtgtgaggttccagggcttttgttgctgagtgcgagtggaagtgactgagttcacttgctaatttggctttcagattcctcatcatttatttccttgttttcttttctctcacatacccattataaaagtatatatatatatatatatatatatatatatatatatatatatatacacacacacacacacacacacatttttttttttttttttttgagacagtctcactctgtcacccaggctggagtgcagtggcacgatctcggcttactgcaacctgtctcccgggctcaagcaattctcctgcctcgcctcctgagtagctgggattacaggcatgtgccactacgtccagctaatttttgtatttttagtagagacggggtttcaccaagttggccaggctggtctcaaactcctgacctcaggtaatgcgtctgcctcggcctcccaaagtgctgggattacaggcctgagccactgcgcccggccaaggatattttatatttttatctggatttttagatagctgtcttacagtgagagataattcaggttttttggtttaacatattgccaggaaaataaatcctttcttggttattttaataaagaagatacagtactataaacttttttcattcttttgggatgtataaagcaaaatgcaaaacgttctctatactctttcctcaatttgtcagtcccattttttaaggatagttatatttttcagattgttatttatatttccagaaatacttcatatttctgtatgttaatataaattagattaattataaattttcctgattaagatatatgagaaatcacagatattaaaatgagaaagttaaaacaatttccttgataactttatgaaagtgagtgggtgactttctgtgaaaatataaattgcttaaataagggaaaattctagtgctatttgatgtttcagcacatatggaactaataaaagctcaatttttagtagtctagtgtaacattaatatcaaaacttgggaaaatattagaaaagaaagctacaactgcgttgactaaggtgtgaatagggaaatcttaaattcaaaataggtggagttcaaactttattgcatattttagtaggtctcttccaggaacagaaatatctatcagttttaggaatccttgtaagtggatcaaatgaaaacatgatcatttcagtagttactgaaattacatttgataaaattcaacatccatccctcataatagaggttttatttttagaattcttgttagaaaaattgtgagatcattgtttaaaaatctttttcctcaattcgttttctagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaaggtgggtaagccagttatttaatgatttaacctcaaaaatctgtgctgttagttaaaattactttcttttcagtgactgaattaaaatgccaaatatttggcaagttctttgtggtgtatattgtatgttctactcctgccacaaattatgtgagagcagattaagaaaagattatttaaaacttacttgcattgattaaaggaagactgctgaatgcaactttaagataatatttttataataaggttcttttatgtgttacctttgtaaaacattttaagatggatttttcttactatatcctcattaaacaaccagggacaatagagttgttaaattatttcctatctcacataaaagaaaacctaggtgtaaagttgttacaagataagactagttagttagcaccagagccaaagttaaaaccaaggtctcccaatgtaaacacagtgttttaattctggaaactgtttgaatcttagcttatataataaaatcagacataaaagtagttttcagaaagtaattagtagcttcagaatggaggaggaggtaatgttgacataatttaaaactgattacaacggaaatataacttgggcaaaaaataatttatacttgttttggcatcagtgaaggaagtaagctaattgggtgtggaaaaataattttaaattttgggaatttatttcaaatctggttaccgaatggtggctcaaggcaggctaccttattgtgactctgggcgcttttattgaaagacaagaattccaggtcctgtgcagacatactgagttacagtgtcaaggtaggagttgagaatctgagttttttgaacatgcttctggtgatccaagtttgggaacttctagtctactgcataaatgttactagcattttccagaattgggtataatgttacctattctatattattaatctgcatgctcatacttaattgctcattgtaatatatatattttcaacattgggaaggaataagcatgtatattattgtcaagttatgtatatgttgaattttaaaatatttattgtagtgggccatacttagactgatggagaaaaatcatatggctttggttttcagagatagttctcacttttgtaatgtaaaattataaatatataccttaatcttatttttgatttttatactactgtacaattgttaatctatttataaatcagaaaagtgttccctttaagctcacagttcttgatggttcaaaaatgcaaccaatttatctttgttgttggaatgtgttctcttccattataaattttaaaaattgcacctaaggatttgatgcaacaataccacgtttcattatcagattattactgtaaatgataaatcatgtatcatgttgacataattgaatttatgtgatggttaacttaaacatttttctcttccagctttgagtcttggtttgacatcactagtctttctgaaactgctgaagatattattgctaaagaaagagaacagaatgtattgcatatgctgcaccaggttttccatgttttcttattctgcttaaccataggctcgatagagtataaaaggaactctggagatcacctgtctaaccctttgtagtagagatttgaaaaatgaagatcctcctacatttaaatgactcctttgtcctttcttctcccagaggtcacatggttttatgacagaactcaagtgcttacctaagttttgtccttttcagatagtatactcattttacccctaatggttactgataagtttgtcaagcacaaaacagaagtatgtggtttttatggaatgcttgccaataatacttttataatttacatccttgcatggctgctgtctaatctatttttattgcttcctgtaattcctaccccatcctacctatctttaatttagagaaacattatctttcaagggtaatctagtcatatgggcctgaaaagcttctcagttgtggtttagcaattttattcaaagtctttatcgttttttctgatattaaagtttatacatgttcatgagaaaaacgtgaagcaggagagaagtgaaaagtaaaaatatcacttcctcttaaaattgtatttcctagcagtgcatgtggaatgattatgttgtgttatatgacaatccaaactcttttctgtctttgtgtaaacacgtgtgttttatctatattttatgaagaaaaggactttaaaaataaaattgttccttaagatagtcttttaaacagttatcagaaaattattttccttttactacatgtagatttaaatcagtttttaatagctgcttattatcccattgtcttgttctactataattaataatatctatctcttcctcttttcaaaattttcaacaatataaacaaggttgtagtatctgtatttaaaactacacctttgcccatttctggctatttccttaggaaagaattcctagaatgtatgtgtcagagtttacagatgagggcttctttgaaggcaaattgccctccagaaaagatttatatgatatacgtccatatgaaaatacttatttactcaagcttcataccaattttgaggttagaagtccttttcagtgttgcagagattaaaaaggatgattattgctgaattgagatgtttattgactattggtagttccttgtggccatattccaacatgtgttggaatatttatttattaatggtttataataactatatgttaaaaataagttaatgttgcaaataatttctttcccctcactttttgggataaactttgtttatggtatctttgtgtgtgttcatgtgcacaagcgtgtgtgtttatatttaaaattttctttttttcccactgtgactctgggcaatgacagaaatttcaatgcaccaatagttatagaagcttttaaatgtcccagtctgaattattggagtaaatgacttatttaggaagagatgtgtttggatatcacatcctcatcagtagtgtatacatccatatagtgtagcaaaggattaagtttctgttcttaggaaatttaattagagtcaagacaatgaatatttatagaatttgtcacttacacgttacctcacagtgtatacaggtagatagatattccttagaaatgatcatctgccttttgattgaacatttgtagtaattgtcatagttgataattccataagagggctcactggaattgttttactatagataacttcagatttccattaatattaagatatgataatgaacttttattatatccaaattcaacagttttatcaaaaataggggcagttttgaatgttctagcaataagaatattctctgtaatactgtgcttaaatttgagtttatattacttttacgctttgtcctaattatgttttaatgcattactacaggaaaaagttttcattcaaaatgaattcagattaggtggagatagttttaaatcgctagtatattttcttaactattttctatatgaaagaattcctttcctttttttatgcaatgtttacataaaccttgcatagtaaaaaaaattttttttactttccgtttaaagttctctaagcttgctacttttctatttccaccccatattgaaggccaaaagcagtataacctttacaaattaattatttaaaattttttattttaaaattatgcgtacacggtaagatatttttaaatgttataaacatttagaaattaaaaagtaagaagtaaaaatttctgttttccttctgcacttcctttcttatctccaaagtataactaatagtttttttgttttgttttttttttttgtttgtttttgtttttttttttgtttttttggttttttttttttgagacagagtctcactctgttgcccaggcctggagtgcagtgagcgtctgcctcccaggttcaagcgattttcctgccttagcctcctgagcagctgggattacaggcgtgtgccaccacacctggctaatttttttgtatttttagtggagacgaggtttcaccatgttggccaggctggtcttaaactcctgacctcaagtgatctgcccgccttggcctcccaaagtgctgggattacaggtgtgagccactgcacctggccaacagatttttttttttttttttagagacaatgtcctactatgacatccaggcaggagagtagtggtgccatcgttggttattgggttgttatctgcagcctccaactcatactcctgggttcaagtgatcctcctgcctcagccttctgagttgctggaaccaaaggtgcatgccaccaggtccagctaatttttggtagatgggtcttgtataagtcttgtttttgtctgctttgaaagcttgtatactaggaaaaacatatataaataccttttttatacatgtgtttcagcggtatagtgtgcctcttcttccacatatttgccatttcagttaacatcaaactatagcatttgtcagtgcatgtggtagaaaaatatctggttatttcatgttttccttacagacatggacatgttttttttaattttatttatttatttttatttttttgagacagaatcttgctctattgcccaggctggagtgccgtggtgcaatctcggctcactgcaagctgcacctcccgggttcacgctattctcctgcctcagcctcccgagtagctgggactacaggcgcctgccactacgcctggctaattttttctattttttagtagagacggagtttcactgtgttagccgggatggtctcgatctcctgacctcgtgatccgcctgccttggcctcccaaagtgctgggattacaggcgtgagccaccgcgcccggccggacatgttttaacatgtttatgaaacatttacatatttttcctgattgcctgtcggcatatttgtttttgggttggtagataccaacactggtaatgtgtttactatctttggtaatagtctgtctatgattagctctatacctgttgggtatttaagtccagagtcctgaaaatgagctttattatatatgattactatatgtaaaccattgtcagtatttaatggcaggggtataaagagtatacaattatttgtttattattattagtagtagtagtagtattttttttgagtcaacgtctctgtcgcccaggctagggtgcagtggcaagatcttggctcactgcaacctctgtctcccaagttcaagccattctcctgcctcagccttccgagtagctgggattctgtaatcccgccaccacgcctgactaaatttttttgtttttttagtagagacgggatttcaccatgttggccaggctagtctcaaacttctgacctcaggtgatctgctcgcctcggcttcccaaactgctgggattacaggtgtgagctactgcgtccgacctagagtatacaatgattttaatctagtatttgtgctcttttagtgacccgaatattttaatgcataattattgtctgttgcttctgtgttctctttataaatgtgataatcatttgtaaccaccccagctaatgaaagagaataattttaagcctgaaactttagaacttatagaaggaaacttgtatgtctgcatccctaggtcagctggctttttactgagtcttaaaacctcattctattaaaaaatttttaatttttaaaaaaacttttagttttttgggtacatagtagatgtatatatttatgaggtatatgttttgatattgatacagaaatgcaatgcataataatcatatcatggagaatggggtatccatcccttcaagcatttgttaccctttgtgttacaaatgatccagttatacacttttgtgtgtgtgtgtgtgtggagacagagtcttgctctgtcacccaggctggagtgcagtggcacaatcctggttcactgcaacctctgccttccaggttcaaacaattctcctgcctcagcctcttgagtagctgggattacaggtacccgccagcacacccagctaatttttgtatttttagtggagatggggtttcaccatgttcaccaggctggtctcaaactcttgacccaggtgattcacccgtcttggcctcccaaagtgctgtgattacaagtgtgagccaccgcacctggcctctagttatactcttctttatattttaaaatgtaaaagttaaattattattgactgtagtcaccctgttgtgctaccaaatattaggtcttattatttctactttttgtactcattatttcaaatatttttaatttttattcatttttattatttccccttttgtatggtgctgataacatctcattctaaaagttgtgggctataactgaaacttcaaccctaagaaatacaaatgctacctttatatttttacttttaaaattatttgagatagattcttacagtttttaaaagaaaataaattctgaaatgctgcggacaactgtgagtttatcatttggtctggtctgggaaaatctcaagatattttcaccttttgagatttggcattatttatataggaagtcaaaagataaggtaaaggagtatatggggacagtattccttgaaaaacaagaatgtttaatactcatatttttctgttcatgttttaattttagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgaggtatagtggttttgaaatgtactgtaaatgaaacttgacatataaaatttctcttttttccctttttttttgagagaaggtgtcgctctgtcacccaggctgtggtgcagtggcacaatcactgctcactgcagcctttacctgcctggctaaattttttgtatttttttgtagagactggcatttcgccatgtttcccaggttggtctcagactcctgggcttaagcagtccacccaccttggcctcccaaagtgctgggattccaggttttagcaattgtgcctggcctaaattccagttttaaggtccccttgttcatttttaggacttgggtgaatttctaactggggtataaggcataaggcttagtggcaaaagttgtttcctagtatctggagtcctgctaaaatgttaagtgataatctttgtattaattgctttacagtcatctggaatacttactaaaaatttaggccaggcacggtggctcatgcctgttatcccagcactttgagaggccgaggcgggtggatcacctgaggtcgggaatttgagaccagtctgaccaacatggagaaaaccctgtctctactaaaaacacaaaattagctaggcgtggtggcgcatgcctgtaatcctagctactcaggaaggctgaggcaggagaatcacttgaacccgggagacggaggttgtggtgagccaagattgtgcctttgcactccagcctgggcagcaagagcgaaactccgtctcaaaaaaaataaataaaaaaaaaatgtatatttccgtacagattaactctaatcatgctttctggagatgaacttggaaatgcatttttaacaagcacacaggtaggtatttgagaatccctgtactaaggacttggcaactagactaatctccagatatacagattgagcatccaaaatctgagttgctccaaaatttgaaactttgagtgctgatatgaaactgaaaggaaatgcttattggagcatttgtattttcccgttagggatgttctacctgtacagtttccttacagaaggttattgataaccaaaaagattaataatcaatttgatgatgattattcatcacccaccatattataggagatagaggtgggatgttattatcatgtaactgaaggagacccttaagttttgtttaactttccaggttttttattgtacactataaacctacgtattttcttttcaaaatatttattgtgatgcatttttaaacaataggaccaccagactcttctccccccgacttttttttttttttttttttttttgagacagagtctcgctgtgttgcccaggctggagtgtagtggcatgatcttggcttactgcaagctccgcctcccgggttcatgccattctcctgcctcagcctcccgagtagctgggactacagtcgcccgccaccacgcttggctaattttttctatttttgagtagagacggggtttcaccatggtagccaggatggtctcgatcttctgaccttgtgatctgcccgcctcggcctccgaaagtgctgggtttacaggcgtgagccaccgtacccggcctcttctccctttttaataattaattataattaaaggaagggtctagccgtttacaaatttacattatttgtctgttaatgagcaatttcataatgagcagtttcatgcagtgttacaccagtctgaagaaatatcctctgtactgcaaatttccggagccatatttcaactttaaggtattaaatccttttgtgtaagttcaaagtagttttatacacccttcatttttacctattgagatatgaaggcccttcctcttactttcagatattgttgtccatgttaaaattaaactaatttcccacaacatttgtatttgtctatagattgtcattttgtacataaaatatgccttattttgtttacatttagaacctaaggacatagctttataaactgaatttcttttaattcgttcccttttagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaaggtttgaattcaaaagtgaatttaagtattctttaaactgtgaccattttttgcatttcccatatatgcattatttgttttggtagagctgttgtggaagtgaatatccctgtagaatctgaagttaatctgaagctgcagaatataatgatgctacttcgtaaatgttgtaatcatccatatttgattgaatatcctatagaccctgttacacaagaatttaaggtgaatactgtttaattctaatttactgttttgatttccattacttttatattggtggaaagtgttactttttttgattataattattaaaaataagtatggtgctatttgtcatgaagattgtaatccttcagtaagctgagacagtcttctttccgaaatttcagagaaccttatcagggttagaaaaatggtcactttctatgagcaactagttttttaaatttttttattttttatagagacagggtcttgctatgtttctcaggctggtctcaaacttcctggtttctcaggcaatcctgcctcagcttcccagagtgctaggattacaggcaagagccaccacgcttggcctctatgcaacttatatttttatttacatattttatgtgaacaactaagaattctaaatttagtaattgatttgtactctgcatgtttacttgttatattttagagagagtggtcatcttttcactatttcttttatcattaatatttggcttatcaaaatcagcctggttgctcattgcttaaagatcaacaggtagccatagaataaaaccagttttgatttggaggttttcaaattaagtaaatgaagttgctttcttgggtagttgatagaatgatagcataatatcaatagaaataaattcttagtaaccctcaatcacagttgtttcaaggtagtttacaataggcttttccactcctggcaatattgacattttgggccagataattctttcttaggaggtaatgttctgtgcacttaggacatttagcagcatccctgtcttctacccattagatgccactagtattcacttccctcagttatgacaactaaaaagtttgctgccgctgccaaatataccctggggataggtggagggcaaaattgtccccatttgagaggcactgctttacatctttattagagtaagaaggaagacaaaactttcccactcaaatgaaagtagctctctcatgagggaatttcaccagaaggtgaaaaagtctttgtccacaatatttagattacttatcagctcctgtattttctcttaatttctggtaagaattctagcagtagtttacatatacatttagttggaaataactcacttataaagaataagcctgagtatgtacccattaagtttgacataattgttttctttcacaatgactttgagagaggagtgttgaggttagatcaaagttatatttgtactttgtttttgtgaaattgctggttttacattctagagtatgtctttgagtaataactatcttctgattttacaaagattgaataacaggtcagtttttaagttttttaagtgacttggctttgaaaattgaactttccaaatggcttttgttttaacaaagcaaataacagttttctctctattttttcttcctttgcccctccttaagatcgatgaagaattggtaacaaattctgggaagttcttgattttggatcgaatgctgccagaactaaaaaaaagaggtcacaaggtggtacttttgattggaattttggattgttcaattatttttttatcaatcattagaaatattaagatatgtttaatttcaggtgctgcttttttcacaaatgacaagcatgttggacattttgatggattactgccatctcagagatttcaacttcagcaggcttgatgggtccatgtcttactcagagagagaaaaaaacgtaagactacttatgtcatacataccaaactattcttttataattcctatcttgatttctgaagtaatattccaaatagacccacaaattgataaaaagatagaaatgaccagaaaccctgtggttttatcaaaaacaaacattttgatttagtactaagaagtcttaatttttgattcacaaatatatatatcttctggcacaatcttattaataatatcctacttaaccatcactgtaagaatattgggatagcaggaaattttttgcctttttgccctgtcctcaactttctattatgaaaatatcaactatatggcaaagttgaaaaaaaaaaagcaactgtaaatccgcctacaatctgctgttaacatttgactatacctttttaaaaacacatttcctgtaatagcagccttgctgtatccattcagcatttaatcctggttttttggtgcatttaaaaataaaatatagatgatactacccttttccgtaatgacttcagcatattttatcttttggggtaaaatttacacatactgaagcaaataatgtatacatttgctgaatctttctgacaaatgcatatgtaaatttatacctaacccctattaagatatagaatgttaccatcagcccagaaagtttcctgtgcccccttctagtcaattctcccctgcacccaccccatgtgtttagacaactacaattttttcatcattttttgatattagcttttcttatttaaacattgttgtgatacatggtttttaacaaaattaagatctctttaatataggtgcttggacgataaagctaacagcacaggttttgttaacataattgttttatagatctgaatgatttgtttggcctcctttgtttaagtctttaatagttgtaattgaaaacatttttctccttcagtcttgttggttaatttattttaatctgttgtatttacatcctttttgcttttagatgcacagcttcaacacggatccagaggtgtttatcttcttagtgagtacacgagctggtggcctgggcattaatctgactgcagcagatacagttatcatttatgatagtgattgggtaagttggaagtatagcaaggaatatgctgattatatttccattttgaatttttttttttttttgaaatggagtctcactctgttgcccaggctggagtgcagtggcacgatctcggctcactgcaaccttcacctcctgggttcaagtgattctcttgcctcagccccctgagtagctgtgactataggtgtacaccacaatgcctggctaatttttgtgtttttagtagagacggggttttgccatgttggccaggctctcttgaatcctgacctcaggtgatccgcccacctcggcctcccaaagtgctggcattacaggcttgagccaccacacccagcctccattctgaatttttttttttttttttttttgagaaggagttttgctcttgttgcccaggctgggattaagtgctgggattaccagcatgagccaccgcgcccggccattctgaatttttaatttttaatggtacatgttacaaatttacttatctattttgaaaagatacccattttcagctaagagttatttcttcataaagttttttgcaagtaaaaattgaaaatttttttttacttttgtttttagtgacagggtctcactatcacccaggcttgagtgcagtggcaccatcacggctcagtagccttgaccttttggattcaagtgatcctcccacctcattctctcaagtagctgggtctatgggtgtgctaccatgcccacaaaaaatgtaaaaattagtgagaccacgtctcactgtttgcccacgctggtcttgtatcctcatatgatcctcctgccttggcttcccaaaatgctgagattataggagtgagtcatcgtgcccatcctgaaatgttttctttagggtatttaaacttttttgttaatattgtcaaggatctgtggaatgataattttgtctatgaagccactctggaagtttaaattaagacaccactatttaaaagttcctggctagatcattcatgttgactttatccacatgagtttatgttaattttaacctaataccgttaaatattatttttctttttaactttaagaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaagtaaataacacttatgtagtgctttattgtttaaattgtgcattgtgtgttgtggattttgtttttattttgtttataaaatattacagcctgggccgagttctgtgtctcacacctgtaatcctagtactttgggatgccaaggtgagtggatcacgaggtcaggagttcgagaccaggctggccaagatggtgaaaccgcgtctctactaacaatacaaaaattagctgggctcggtggcgggcgcctgtaatcccagctactcaggaagctgaggcaggagaatcgcttgaacccgggaggaggaggttgcagtgagccgagatcgtgccactgcactctagcctgggtaacagaacaagactctgtctcaaaaaaaaaaatattaacagcctgatatgacaggatttaaataagcagtggggaatttgggagcctaaactaagttggtcaccatagacataaaagaaagaatgttagcgagtatgtagatatgtagatgaagagcagatgggcagagaaaaggggtcaaggataactacatgttcctgataagagattggcttgctaaaagttttaagataaatattttgcaagttccatgtattaaaatattaagtgtatttaagtgttataaaaaatctatttatttattgaacccactgtttcacagaatatttcactgcagaatgccctttttatagttttggacacttttttttcctttttcatttccttatcataaccagatgggtctcaacaatgctttttaatctagaaaaaattctgaggaggtggggaactgacataggtgaaaaagttttgttcctgagattccttagagaagttatacttctatccattcaccataaaattttctttgaataaatggcttgatagctacctgaagaaatgttgaaaatcatttatgtaaatcatcaagccctagagaaatgggaacatgataatgttaatgtgaaaagtaatgttggaaatcactaataatttattttatactccttttccacttgtaaatactttctctgggttttgaggtaagagtgtattaaggtttagacaaaattaatttggtgaaacatttagattgtaattggaacttgcattggggaaaaagcataatttttttttaagagaccatttaacttttttacccaggttgttctcgaacacctggactcaagtgatcctcctgccttagcctcttcaagtgttgggcttataggtgtgagccactgtgctcagccctattttcgattttttagtagattaattttgtagaaaattttgaagggatttttttaaatgctgacatttttcagttgagttattacatacatacagcaaaatgcacagatcttaaatgtacaggttaatgaagtttgaccagatttatgtactcctatgtaactatcatcgagatcaaggtagcattttcatcatccaagaaattttctttgttcaccctttccagtaattcctatgctccccttaccatcactaggaagcatccagtattctgatttttgtcacactgatgagtcttttttctgtttagctattttgttgaatatattttttcaacacagagtcatctgtgttgtttttagtagaatttttttcttttaattggtgaatagtttgttttttccattctcctgttggtcgacatttaaattatttctagattctggttattatgaataagttggtcctgtacaagtctttgtggacataatgcattttttggtccttgatcttagggagggtgcgtgtttaactactggaaactaccagccttttccaaagtggacatatcattttccagtcctaccagcgaagcctgagagcttcatttgcttttattttttatcaacacttttttttgccgtccttcttaatgcaagccattgtgattggtttgtaatatgttgtattgtagttttaaaaggaattttaatgtttttaatttctcattttttttagatcatttcaaaggtggtcagtctggattaaatctgtctaagaatttcttagatcctaaggaattaatggaattattaaaatctagagattatgaaaggtgagtttttaattttagaaagatttaatttgtagctttgaattattcacatagacttgaatattttgttttctatagggaaataaaaggatcaagagagaaggtcattagtgataaagatctagagttgttgttagatcgaagtgatcttattggtaagtattatgcttttttttaatggaagcttcgaaacatacacttaattagcataatgtaatgaaccccttgtgcaattcattcagccacatgtatccaatcttgttttattgtcatttttcttcttagagtattaaaatcaaatctcagacatgacattttgcccataaatgtcattatctttaacttcttccataattcagatattttctgtaaactggtaaataacacttgtaaatgaatatattcaagttcctgtcttagttaagaataccagtgctttgttctcatatttttcgtcataccaggaggcacatcgtatctggatttcttatttccagtgagctaagattaatcaagataatgttataaagtgtcttgtcagccttcatcctttacttaacacgatgatttattttattttattttatttttttggagacagagtcttgccctgtcgcccaggctggagtgcgctgacacgatctcagctcactgcaacctcagcctcctgggttcaagggattctcctgcctcagcctccctagtagctagtattacagtcgcctgccaccacacctggctaatttttgtatctttagtagagacagggtttcgccatgttggccaggctggtcttgaactcctgatttcaggtgttgtgcccaccccagcctcccaaagcactgggattacaggcatgagccactgcaccaagcctaacgtggtgatttttagtatcccttgaaagtggctgataagaaccattattaacttaatcattgcaaaatggtgatttttcttgttctgtcattcttttattagctgggttatttaagaactttcccttacagtttccctgagatagaagagagccaggatatattgcttcttttttttttttttatcagtttttagaataccaccttatgatctgatgcctacagtgatgaccatgaattattttgaaaacaaaaataatattttgtacttcataatttcctaattattttacaacatattactgtcgtctaggctattgattatttgtctgttgcatctgtatggtggagatactgtataatctttttttcccaactgtattccgtgacattttggtcttttgaaattggtgatggcagtaacattcatatcacggatacaggcagaaactagaaaccccagtctttgtttttaacaaaaaagggtcttgctttgtattcctggctagaatgcaggagtgcgactatagctcattgcagcctaaaagtcctgggctcaagggatcctccagcctcagcctttggagtaagctgggattataggcatgagccattgtgcctcagtttttgttttttttgagacccaattgttaaacatttacctgcgtggcactggctacagtgtcatgatatcttattttcaaatatgttgttcattttaaaattcaattctgtgtcttattgaatcaaaataaaatatattggttggaagtttttttttttttttttttaatcagatgtattttccaaacattttcttctactctggcctgtctcttcacttacttacttagtatcttctgaagagcaaaagttttaaattttaatgaatttcaattttaacaaatttttttctgttcactcatgatttttatgtcatctgtaactactctttgcctaattcaaggtgttgatattttcttttaatagttttatagtttttgctcttacatttagatctatgatctattttcaatgaattttcatctttttgcatgtcaatattaatttgttaaaaagatgatcctttttctattggatggccttgtcatccttgatgcaaataatttgatcataaatataaggatttatttctgtattctcaattctgtcccattgatctctgtggtattcctatgccagtatcgcactgatttaattaaggtagctttatgggaagtgtactttctctagttttgttctttttcaaaattgttttagatattctggattatttgcatgtttatttgagttttaactttgaaatagtttagggagaaatatgagacatacagcatcatggtcaaatctaaactatattaaaaaacaacattatgtgaggcatgtaaggactgtttaacatctgataatataattcatatcaattaaataatggagaactagatgatcacctaattagataccaaaaaccaacttgccataatatcgtaatcatcttcataatttttttttatttgagacaaagtctcgttctgtcaccgaggctggagttcagtggtgtgatcatggctcactgcagctttaacctgctgggctcaatcaatccccacacctcagcctcccaagttgctgggactgcaggtgtgattactatgtcctgctaattttgttttgtgtattttgtagagacaggggtttgccatgttgctcaagctggtctcacactcctgggctcaagtgatctgtctgcctcatcctcctaaagtgctggcattatcgaaactgcttttatttgcaagtggtctggtttgattatcttcataggaagtccaagggaatccagaatcttttaaaatagaatttaagaagattgcttattaataatatgtgtaacagcaataattgtttaataatgaaggtttttacaacagctacaaaattaacatgcctacaattaaagtttaacaatttttaacatgtttatataaggacagaattatgaaacattgaaggacgttaatagaaagactgagtaaacatgcagatttagctgtatttgtggatatgaatggttactacaaagtgtaagtcagtggtccccaaaactaacttatattcttgaatttttcttctaattaaaatcccagaatgatggctgggtgtggtggctcatgcctataatcctatcactttgggaggctgaggcaggtggattgcctgagctcaggagttagagaccagcctgggcaacacggtgaaaccctgtctctactaaaatagaaaaaattagcggggcatggaggcatgtgcctataatcccagctactcagaaggctgaggcaggagaattgctagaacctggcaggtggaggttgcagtgaatggagattgtgccactgcactccagcctgggtgacagagcgagactctgtctcttaaaaaaaaaaaaaaaaatcccagaatgactttttgtaaaacagactgttgttaaaatttatatgagagagtaataaagggccagaaccaagacagttttgaagcacaagatattctataccaggtataaagtcttattaaaaatttaaaagtcataataatcaagatggtagaattagcacatggtgtgatatattggctagaagtacaatatggtgaatctagaaagacaactttcacgaaaagctaataaatgtgaaatggaacttcaaacaactgataggaaattcctattaatcaatagatgatctggggaaatagtaattaataggggaaaaattaacttagattctcctctcctcacactgcacttacaaacttcagataaattaacaatccacgtgttcaaaacctaaatattaaaggtagaattttaacctaaaaagacaagaaaatatatttatgattttagaattagaattctttataatacagaaatcacaaattatatgataggtttcatagattttaattacattaataggaaagactactataagacagatgacaccataaagagataagagacaaaccacaaataatatttgcaacatataacaggaagtgtttaggatatgcaagtaaataaaagttgataatgaaaacggataatataagagcaggctattaccaagagagaaagaaatgtctgatgaacagacaaggatgattagaaatcagtaatacaaatgaaaatcagatttcatttcacagctgtcatgttgataaaaatttaggagactacatattgtcattgattcaaaatgtttctcaaggtaagctttttgtggtgtgttttcagctattaaacgaatcgtgattgggcctctttttaaaacgtttctgacaacatgattcaaattgatattatttattgctctttgacttgtttatcttaccttaaattcagcaaaagcgattttgactagcaaactgatgctttagattgtatgctcccaagagtctgattctagttgttgtattaagaatagtgtacctttttgctttcactgctattaaatcttggtgattaaggaagagagtgccctgtattactgtgagttttataattttggacagatgactcacttctcataacatcatattggatgtttcttttacgatttcttcttcttatacttctaaaatgtacctgttttaatgtttttcccttagatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatgatctcattaaattatttcttcaggaatagcttaggtgcaataatagcaaaagacttggctgtcggtaggatttggttattttgttttcttggtttcattcactagtactataggagtgtgtcatatagagatttcaagtggacattgtgttagcacaagagaagtttctgaatgaaactttagggtcttgagaaacgactagaaattggaaatggtagtgtatcatgcaaaacaagacagaccctgaaaatttatagtagtgggttaactagaaccaaatataagagaataggccttaggaatatgtaagtaatgcacaatctgtaatagaacagcataaaggccaaaagaggcacaatttagaccctgtgtgaaaggatatcagacaatgaggaagagaaatcctgaatgtaccctggagaggggacatactccataagccatacatttctgtgttagtgtttatttcatggaaaaatattgctgttgccatgtatattcaaatgcagatcagatgatctgttaaggataatggaaccgtcacttaagaaaaacttaattttttttccctgtgtcctattggcacaggtcttttcttttaaatttttattttaatcgttttgaggtacaggtgggttttggttacatggataagttctttggtggtgaagaaaaacttcagatagaacatttggttaaataaaagactatagagcaggtttatttgttttttaagtcaaaatgttaacccattacataagcatgctgacctaggcttgcttgaaactcgtgatcttgtccttagtgacccagtctttcctgttacattgtcctaaatgactggtttcatagttttactctgtcattgcacgtctcatatctcctccctctcactttgctccctattgccctgagaaaatagacgcagtcagaaaagaatctttaaaagttgtcaccgttgcatctgtaaacctagcatctgtgcccatctgtccccatctgccctttattatatactgcggatatattgtttgtcgtagcttgagccaattgcaatgtctcatttcttttataacaaagctccttgaaaaagagttctattatagcaaaactccttgcctgtattcattgtttttagtttgttctgttttttctgaacccattccaatcagatattcatttccattggagctggtatttttaaggtctcgtgacgtcagtgacctcattttacttgatctattagcagcatttcatacagttgttgactcttctccattaaaacatttactttatttggcttctaggaaacatattttcctgctttttcttcctatttctctgactcttttctcagtttcctttgctgtttccttttctatcctctaaacattgaaatatcctaagcctagtttgggattcccttgatggtcttcatttctttaatgggaactgtgctggtgactcaaatttatatctccagccagaacctttctcctgaattccagattcacatatccgactgtttactaggtgcttgataactatatctgtacttttcatcttgtttaatccaaatttacttcttttgcattttccttagttcaataaatgacaactttattcttccagttatttaaaccaaaaatcttagagtcattcttctcttccttccctcatatttcatgtctgattctaaaggaaatcttgttgcctgtactttttctttctttcctttttttcccctttttttgagtctcgcactgtcgcccaggctggagtgcagtagtgcaatctcagctgactgcaatctctgtgtcccgggttcaagcgattctcctacctcagcctcctgagcagctggggttacaggtgcatgccaccatgcctggctaatttttatatttttagtagagactgggtttcaccatgttggtaaggctggtctccaactcctgaccttgtgatctgcccgccttggcctcccaaagtgctgggattgcaggcgtgagccaccacatctggctttttttttttttttttttataaacagtttcacttcgtcacctgggctgaagtacagtggtgtgatcttggctcactgcaacatctgccccccgggtttaagtgattctcattccttggcctcccgagtagctgggactagaagtgtgcgccaccacacctggctaattttcttatttttagtagaaacgtggtttcaccatgttggccaggctggtctcgaactcctcacctcaactgatcatctgcctcggactaagtgctgggattacaggcctgagccaatgcgcccagcctactttctataaaagtcgtcatgtctctgcccccaccccccgccaccccccacatagtctgtttcatttgattttccccttagtttagtgttttattttgatgtttcttcagatgccttgggatcatttactgttcctcatatttaagagcaaatgcttaaaaattcttagaaataccttcttgaaaagcctgcattcctaccacctctcaccacttcaacatgaaataatgatcccttacatctttttagtgtagttatataacttttgattggctcaataattacttttattatggctgtgtaagtattattaaagctttagataagccatggaatatgctgtgattttattttcattcttgtgcagctttttttttctccctgaagttaatacttaactgttttttacctaccagtaatttatatctaatcactctggaaatataagcccctcagtatattaaaacagatctcatgattcagtaataaacctccccctccaaatatatcccatcacctctactccctggaacattcttctagtttggactgtagaactgattccatctggaaccttcctttaccatactcctgggtattcctgttggctgtttcatgttttggaattactgtttactgtgtcttgtgtctccccccccccccctttttttttcctttaagacagagtttcactcttgttgcccaggctggagtgcaatggcttgatctcggctcactgcaacctctgtctcccaggtttaaactattctcctgcctcagcctcctgagtagctagaattacaagcgcccaccaccatgcccagctaatttttgtatttttagtagggacagggtttcaccatgttggccacgctggtctcgaactcctgacctcaggtgatccaccctcctcggcctcccaaagtgttggtactacaggtgtgagccactgcgcctggctggatctaactttttttcctccttggtttactcgctcactttgatggattatgttgtcttgtgttttcccaagaaaagaattcaagggaaatgaattttttgagaactcgcatatctggctgtatttttgttggattcttatatttgatggatagttctggtttgggattttagagtaggaattattatcttctcagaatttcgaaagttgttgtgttgtctcagaacttccagtgttgtgggagagaaaattaatggttccttttttttttttttttttttgagacagggtctcattctgtcacctaggcatgaatacagctcactgcagccttgacctcccgggctcaagtgatcctcctgcctcagccaccaatttagtttggaccacagccatgcaccaaatgccctgctaaatttttaattttttgtggagacagggtctcaccatgttgcccaggctggtcctgaactcctgggctccagcaattccccccggcttggcctcccaaagggctgggattacaggtgtgagctcctgcacctggcccgaatgctgctttgatttccagtctgttgaaggtggggggaaccagccttttgttaatgtgagcttccagtgtttctttgtcttttgtattctaaattaataacacagtgatgtgtcttggtatgggtcttttttttttttctttttttttttcatttttaaagagactcctgctatgttgcacagacttgtgaattcctggtttcaagttatctttccccctatgtcactcaagtaatgtggactacactcatgtgacaccatgcccatctttatgttgtgtatcttatttttgttttgttttactcttgaatcagctcagtctgaaaatctgtcttttaattcatggggattttttagaatgatttcttggagggttttgtcttttgaatgtgtggtcccttctctgcctagaatttttttgtttgaatgagacatggtcttgctgttgtccaggttggagagcagtggtgcaactatagctcactacattcttgaatttctgggctcaagccatcttcccatctcagctttcagaatatcttggctacaggcatgtgacactatgcccagataatttaaaaaaaaaaaaaaaatttcttgagacagggtcttgctatgttgcccaggctcgtcttgaattcctgttctcagagggtcctcctatgtttgcttcccaaagcattggtattatatgtatgagccaccaccactagcacttctgcctagaactcgtaacaaaatttctttcccccatctgcatagtcttgtttcattaaatgattcttccctttttaaagtttagtctgtcttttattttgatgcttcttcaaatgccttgggatcatttactgttcctcaaatttaagagctagaagaaatctctctaagc

SEQ ID NO: 14863 - DNA, 8056 bp, Homo sapiens; identical to SEQ ID NO: 6443

SEQ ID NO: 14864 - DNA, 2295 bp, Homo sapiens; identical to SEQ ID NO: 6446

SEQ ID NO: 14865 - DNA, 286 bp, Homo sapiens; identical to SEQ ID NO: 6447

SEQ ID NO: 14866 - DNA, 5888 bp, Homo sapiens
gcatgtcagggatgatccgtctctacgctgctatcatccagctccggtggccatatggaaaccgacaggaggtaggtaaaagaggcttactgtcaataatgagaggttagaccacagtccatgtgtattcctcccacaggaaatgttggccttctttcagagagccagtctagttaaaggataaactatatggcagtttcatgggtattatgtagaggactgaatgttgattattagggaactttcttggatcacctggtactttaaagagctggttttgtaacagagtctaccagaggagagtctgttataaatcagtcattaaggttagaagattttcttacaagaggaatgagcaagaaattgtcatcttagaactagttgagaccttagaagccatctagatcacataccttacttcacagatggacagaacaagctcagaaagctgcagctggggttcagggctttgacttgccagcccaattaatttctcagggaatacagattagaaggacagagaaattaatagttacggagacctaaagagaaaaaatagaagttgattaaatccaagtttttattgtatgcctgctgtgtcccaggttctgtgctaaaggtaccaagaataataaataaaatgtcaataaggctaattgttaccctatggaatgcctgaaactgaagctgacacatgcatattgaagggagcctataaagaatgtgtgggaaccaatgtattgaaacattaaaaaatagaaggcgaggtagcttcaggcctgatatcccagcactttgggaggctgaggtgggtggatcacctaaggtcaggagttcaagaccagcctggccaacatggtgaaaccccgtctctactaaaaatacaaaaattagctgggcatggtggtgggcacctgtaattccagctacttgggaggctgaggcacgagaatcgctttaacccaggaggcagaggtggcaatgagccgagatcacgccattgcactccagcctgggcaacaagagcaaaactctccctcaaaaaaaaaaaaaaaaaaaaaaaaagaatgtgtgggaaccaatgtactgaaacatttaaatacagaaggctgggcgaggtagattcatgcctgtaatcccagccctttaggaagccgagacaggtgggtcatttgactccaggagtttgagaccagcctgggcaacaaggtgaaaccatgtctctaaataaaatacaaaaaaattagctgagcacggtggcatgtgcatgcctgtagtcccagctacttgggagactgaagtggaagaatcacttgagcccaggaggtgaaggctgcagtgatccatgatcgcactatagcactccaacctggacaacaaagtgagaccctgtctcaaaaaaataaaagaaaaacagaatttgtttagtttgtgttatttctgccctgtggcaggtgctagggctggatgatctggggttcatttccacttggtaatggctggatgatacactgggagtttagatttctaaacaaaatgagatcaatgataaccaagcttctctactcccagattcaccctcatggcttaaatcatggatggcgctggttggcacagatcttaaacatggagcccttgtcagatgtgacagccaccctcctctttgacttcctggaggtacgtaactcagttatcacacaagagaaggccagtggttgaggtagccttgatccactgggtgacatgaatggggaaacagcatagcatttgggcctgatagtaaaacagcatgaggttccagtgtcatacatttttcccaagctgtagaccaaccttgctttcacttttactccatactatatttacttggcttctctggatttttttcattataaagaacagaaaattgtacattctagcaaaagtgaaaagaggaatttgttttagggatatagaagggactcccaggccgggtgcggtggatcacacctgtaatcccagcactttgggaggccaaggtgggcggatgacatggggtcaggagttcgagcccagctggtcagtatattgaaaccctgtctgtactaaaaatacaaataaaggccgggcacggtggctcacgcctgtaatcccagcactttgggaggccgaggtggttggattacctgaagtcatgagttcaagacgagcctgtccaacatggtgaaaccccgtctctactaaaaataaaaaatcagccgggtgtgatggtgcacacctgtcatcccagctaccgaggaggctgaggcaggagaatcgcttgaacaggatctcactctgtcagccaggctggagtgcattagtgtgatcatagctcactgtagcctcaaactcttgggctcaagcgatcctaccacctaaccctggcaaagtgttgagattacaggagtgagccattgcactcagccaagaagacacttcttatagaagaaagccttggggtacatgccataacaaatctggaaccatttgatctatagtgccaatagttcctagttaccttaatagctcctgacgtcagccaggtgcagtggctgacagcctttgggaggccaaggcaggcggatcacttgagctctggagttcaagaccagccagggcaatatggtgaaaccctatatctaccaaaaaaatacaaaaattagtggtgtgtgcctgtggtcccagttactgaggaggctgaggttggaggatcacctgagcccagggaggttgaggctacagtgagctgtgatcatgccagtgtcctctagcctgggcgacagagtgagaccctatttcaaaaaaaaataaaaagctcctgaagtcaccatacatgaacaatgatcctgtatcatttgagaacacaagtggtattctgtatactctccttactaagtttgggaggtataccatacctttaggaaggcgtccattcattagaggaaaagaagagtagttcattaagacctgattggttaaatggagatattgccatataaagagaaatgctttagaagaaagttgggtgtttccatttattcccttgttagcaagttcagtggcattgtggttgaaatttttgataggtgtgaaagatgaagggctgattgtgctttatgaatctgtcctgtgagtgtgaattttcattttctgctctgacagtgcctgtctttccctctaggtgtgtgggaatgccctcatgaagcaataccaggttcagttctggaagatgctaattctcatcaaagaggactactttcccaggtatcaggcttgttgagcagacagcaggggattaagtaactcataaccaggcctcagatacccaagggtgctattacctgctggttttgattcaagttaaaaacacctgtactaagtatgacatctttcctactccagtccctctcgttgatatttgaataaatgcttttgaaccttaatgagagtctgtcttaaatatcattgcccaaacaaaaacacaaattaggggctgagcacagtggcttatgcctataattatgcctataattgcagctctttgggaggccacaggaggaggatcacttgagcccaggtgttcaaaaccagcctgggcaatatagcaagaccccatctctacaaaaaaaaaattagccaggcatgatggcatgcatctatagtcccagctactagggaagctgagacaggaggatcgcttgagcccaagagttcaaggcctcggtgagctatgatcgcaccaccgcgctgcactccagcctaggtgacagagtgagacaccgtttccaaaagataggtgtatatcataggtgtgattcatgtgtctttctctccctgtagaattgaagctatcacaagctcaggacagatgggctccttcatacgcctcaagcagttcttggaggtaagatgcccttagaccaacatgccccacactgttgttgggctggaatgcacctatgtctgacaagtcttggaccttccgatgctctgattgcactctcttccttagttcttccaaacccttctttttgttcctaattccctcttaacctttggagtaagggctgccatttcctcttctttatatgtatcattctctatactgcctgtgagaaagctatgctgagatgagtaaaatatatttagtgtatctcctctcattaatatatattttttttgcatgttggccaaggttattttcttagtctcaggtctggggaattggtaagtgtcatcacttttctccatgagatcaaactgcactttcagttggactcttcccctacttccaagtgccaagagattgtaaaaggttaattttgacaaagaatttagaacactatagtgggtttgccaagatagcctgctgacttttcagcttctcaaagctcgattgtgaaaatagtgattgtgaaagatgaggttagcctgtagggagacaagagtgggacaggaataataagagcatttcatttgttgtctggagcagatcatgcagaagtggacatcttatacagaaccatcagtcttactggctttttcctttttgttcactgttccatagggctgaaatatggtgttcctcaaagcttcttttaaccattaagtgttgggaacactgttatcagaaactcattctgttttcttcatctttccctgaccagaaatgtttgcaacacaaggacattcctgtccccaagggctttctgacttcctccttctggcgctcctgatgtcactccatcacccaccatcaccgctgctgcaaagaggcaataataaaggaactgaagacagctgtatttgggagaagtcatgtcagattcagaaatttgccattatgtatttttatgtatttatgccttgtgactaggagaggagattttcatgggtcacaaaattcttggaggtcccttagtagatttggtagttccttaagagatccacgtgataaaataaatggagttggcctttcttgttttttgcaaaagtgataaaaggtctttagcacttggtctcctcccttgtctctagtgtctttcagaaagttggcaataccttaacaaatgcactctgagctggagggagcccaccatttgcacccacctacccaccctcacccctgttcagatgaatttccagaaagagctaaggctcataaggttcccttttaagtattatttaatagttgaggccagatacttacatgcaagtctgggttatggttgttttgcctttctcagcttgtgaagtcattctaaagctagaggaagtatgtgatatacacatggactaaggctcaggtgacactatggctagattaacatctgggattaggactggaaacacatgtcattttgaactaagggaaactctttgtcatcctaatttggaatttggtccctggatggctagggatccatgaaccaggcaggtaccttttttgtttttgttttgttttgtttcttttctgtttgaattaagatgggctaagatggggcttgcaacattaaacatgagctgagcatccataagcattgaattgggattaaataaagatgttgggcaggaactgaacactgctaatatgatgataaatatgcctgactaaagccactacagaaatccagagattggctgttaaaatttgttttgtggaaagactaattctctttgatactgcagaggcagtggccatggatctgttcctctgtgctaaatgtcttgtggcagggtgtgtttgtgggggagtgttcactggtactcttgagtggcctgaagtgacccattctatgaattgttaattaaggtgccaaaaaaaattaataataaagcttggttttttgaaaaacccattgctgata

SEQ ID NO: 14867 - DNA, 344 bp, Homo sapiens
tcaaaaaaaaaaaaaatttttttttaaatttttcaggcatggtggcacatgtctgtagtcccagctactcaggaggctaaggtgggcagatcacttgagcttgggaggtcgaggctgcagcgagctgtgatcatgccactgcactccagcctgggtgacagagcaagaccctgtctcaaaaaaataaataaataaataaggtagacacaatggaatgaacactggggacggagtcaggagaccccggctcaaatcacttttaggttttttggccttgggaaggtccttcacccgctctgaacctcagtatccccacctgtaaaacaaaagaactggacatgtca

SEQ ID NO: 14868 - DNA, 16083 bp, Homo sapiens
taattccagagataaagtgtccacaacagttagggaaatgatgctagagtaagtaaaaacaaaggtaataatttatagcctttaaataaaatcactgggaagggcaaacatttcttactgtgcccatcacctctaaaacttatgctaaaggttaatgaaaatgtatttgtgactgaagtttggtatccatccctttttttccccaaggcactttaaaaatcagcaggacaaccctgaggcaaactggaaggtaaaatatacttttattttacatcttattttctgttgatttagttgttttcactttctactgagtcagtttaatgccgacctataactactttgtcatcaagactcttgggtattcccctggaaaataaggcttcaaacataaaaattggaatacttactttcgaagttagtaagggcaccctttctgaactttattaagaaaaaataaaactcataatttgattatattatggctgtttgtggactggttaacattataaacaattctttaatatggtgtgcatttctagcttcaagattattaagtgacttgactgtggttctttctctatttaaagttgcctgaagattttgctgtggtgtttggagaagcagagggtgaacttgctgttggaggagtcttcttgaggatctttattgcacaaccagcctgggttctaagaaagcctagagaatttcttattgccctgttagaaaaattaactgagctcctagagaagaacaatcctcatgtaagcttcagtcaaaagcaaaacatttcaaagacttggctaactagactgatggtgtttctcttacaaccttattcacaaagaccatgaattaggaattggccagctctttcaatatagcagccacatttaaattcacatatgcccctcgatcatttttttgccatgttcaaaagtgaagctctttagtatgtttatgaaccaaagttatagagatatctatattgagaggatgctatttctaacagttacagaagcctgaaaagaaggtttttactgtccatctctaatgaatatgtaattttaaggagaaacctgtgtgttcggtgttcctctgagagtgtgttctgtttgggcatgtgctgcactctactttgtgtatatggcagggataaccctagtcaaagaaattgacagaagagtagtaactatgtggttgaatcctgtatctgtggctgaggctgccaggaaagcaggagtgagtgaaaaggtaactttggtcttgggtttggcaagccaaataccgtgatagtatataagattttgtttttcaaagtcttttttgttttcagaaggtttaagattttgttgagattgaagacagttgacctacatgattgttgtttaaacaggctggctacagaataaggtgattaagagcctgagtggtgttatttgatggttccagccataccactgaccaggtctgtgaccttgggcagtacctcatgactctgcctcagttgctgcatttatagaatagtcatagcagctgcctctgaggcagaggttctgatgagttaatacatatatagaatgcttaacataatgtctggcacatttcaagtgcttagaaattagttactatcattagcttagtaaaacatatttttaaaacatgattagcttgctgagtatttaccagtgctactttccatagtcatattcctccaataggatttctactacatacatagtttgcttggaaaatgcagtcctcaaaagctaaaacttagggaaagcacatagcagtttcctcctatatcacctttctttttggacacattccaattttaatgttaatttaagatgcattttattatgtttctggatgtgtgcatctagtggtataagctgaaggtctttccaatccgttatccacaatagaaagtgctttgtgggagccagacatgttaaatagtaggatttttaatgaaactgggaaaaacatttcactagttctgcattcttctggattattgttctgacactaacatacctgcaacatggtctaaaaatttctagtaatatcatttgggacatgatctcttaaacctgcaatagaggctgggcgcggtggctcacgcctgtaataccagcactttgggaggccaaggcgggcggatcacctgaggtcaggagttcgagaccagcctcaacatggagaaaccccgtctctactaaaaaaaatacaaaattagccaggcgtggtggtgcatgcctgtaatcccagctacttgggaggctgaggcaggagaattgcttgaacctgggaggcagaggttgtggtgagccgagatcgcgccattgcactccagcctgggcaacaagagcgaaactccgtctcaaaaaaaacctgcaatagaaattgggtatacctaaccgagtaaaatcctgcttagattaaaatagcatattcttaaagtcctttagattcatgccttttatgaaagaaaatgggaagttcgttgttctcttaggattagtgaatctgttttcaagtatcagcacttagaacttttgaatccctagttttgaacaccaaatacattaccttggatatttagggctgtatgagtattttatagttgatttatttttgttttacacctgcagggagaaactctggaaaccttgacaatggcaacagtgtgtctcttcagcgcacaacctcagctggcagatcaggtcccgccattgggccatcttcccaaagttatccaggcaatgaatcataggaacaatgccattcctaagagtgccattcgggttatccatgccttgtctgaaaatgaggtattgatgaatacacttagtagtttataagctccagaatttatctatgctcccttcttgacggatataagttgtagtattatataaatcccctttctgccatgtgtctttttgcatacgaaccacatggtattttattagttctgggtttatcaaaactggtatttatcaaatcagttttgataaataccagtttaggtgatataattaatagattaaatttggttcaattcattgttaaactgaaagtaagggattctttttttacttatttacttattttgttatggtatttactatgttatataaatattgccagtctacaagtaaccttctcttttgggcacttagctgtgtgttcgagccatggcatctttagagaccattggcccactgatgaatggaatgaaaaagcgagcagatactgttggtctagcctgtgaagcaattaatcgaatgtttcagaaggagcagagtgaattagtagcacaagtaagtgactttctagatttagcactattttaggaaagcaaacataccaagtagatttttacctatttggtactgatttggtttccttgacttaaggttggtgagagttaacttgtgagtttgtgtataaacaattttatattttatatatacaaacacatacagtagtgtgtataatacgtgtgtatatgtgtatgtatatatacatggatgtttgtgtatatatacacacacacaaaaatggggccagctgccaacagtcttaccaacttgagagtacttttatggtgtataaaatttacattttggctatccattgtgcaattagcttagtagcttgtttagcttgatttgtaaaatgtgcttcatcctctttggaaaaattcattcgtttatttattcctttgtttcttaagtcatgtttaagaaacatgccaagatactgcctttttcaaagagactatccacctaatgaaaactggacttggtggatatccatgtagacagatgttgatggaacaaaaaagatgcaataaatttaaaaacttacaaaagcgatctttctaaaatgtaactcaaagaacaaataccacatgatctgacttgtaagtggagtctaaaacaatcaaacttatgaagcagagagtagaatagtgattactagaggctggggttggggagaatgggaaaatgctggtcaaaaagtacagtttctgttaggaagaataaggcttttaagatctattgtgcattatgttgactatagctaataatacattgtatatttcaaaattggtaagagtaaattttaaatgtttccacaaaaaaataagtatttgtaatggtagatatgctaattagcttgatttattctgcattgtatgcatgtgtcataacatcactttatttcccataaatacatacaataaaaaataataaagtatttaaatagaattctgaaatataactgagccattcttcatcttaaaaaccattcagtggtttctcattacctgccagatgactaagtgacatctggtatccttagccagaatacaaggccctgcatctttattatctgggcttccccttctcccagcccctcagccttacccactggaccctcattgaggcaagtagagctgttgggtacatctcaaggagatactggatgctctaaggttcagacttatgattggcttgaggagtttgatgtgtaggaaagaacatgagctggtactaccacttgttggctctctgacctcagacatgatatttaaccttaaaatgctcagatttctcatctgtaaaataaggttgtgactatctcacaaggttgttatgagaacagtacctgaaaaaagaggtgcattcactaaatgtcttttatttcttcctattccctctgagtttcaaaatggatagtgaaaattgtgacattagattattattcagcttttattaggctgatatgaaatgtacgatgaccacaaagattgatgtttgaagaaaatatgaaaaaatactaatgtatttcagagattgttgcctattaatacagtgttactagggcaggcagcccagtataggggctaaaagctcaggttctatgttttctggctccagatacatattttaatactgcccagctctgtgattatgaacatactgttttaccctctgtgcattaattgaataaaataattgatgtatagcatttagaatggttaatggacagaataaaatctcattaaataaaaatgtcattagatacttaagcctgtgtatggcattaaaatacggtgcaacaggctgccttccaggtaggtcctgggggtaaaattatttcttcagtggatgatttgcattttttctgtgtgtttatatatgcttaatatttcttctaggccctgaaagcagatttggttccatacctcttaaaattactcgaaggcattggccttgaaaacctggacagcccagcagccactaaggctcagattgttaaagctctcaaggcaatgactcgaagtttgcagtatggagaacaggtgagtctgcatagagtcaacttttgatattctaaaagccagggtcttggccatggatggtccacgtacctgtgttcaagttccacttacagatatggttctgttggttgtaactggagaagatccagagcccaaggatggacttgcatacctgcctcataactgatgaaaaagcataaaccatatactcaatattcaggagaattcttctggatagtgatggcatgttgtacatttcaggaagaaaaatgctggaaatctttagcatggaatatgcagcatttagtgctgcttaagattaactttcagctctaggagttattcatgggtagtgataaccaaattcattaaccatcccataatgctattttaaaagatgtagaacatcatttttgttttcatttcctttcttgctggtgcttaaaaagtgttggtttttttttttctttggtcgtgactttgtttttcctatgtgtgttaatgtatttcagctgcacgtatttgctgacttcaggcctgttcagtaatttaattttcctcattggttttatttttattatttcctctaaggagttcctcattcagtgtactatatagccccatctactaatgctcatttttttttaattgacgtgaaatttacatagcataaaattaaccattttatggtgaatagttaagtggcatttaggacattaacagtgttgtacaaacaccaccgtatctagttccaaaacattttcatcacctctgtacccattcagcagctactctccctttcttccttcccccaacctttggcacccaccaatctgttttctgtctctggatttacctcttctgcgtatttcatataaatataatcatacatatgtgaccctttgtgtctatcttgtcatttagcatgtttttaagcatcatccatgttaccaatgcttcatttttatgtctaaatatgtcattgtacgtaaatgctccaatttgtttatccattcatctattgatggacatttgggttatttcccctactaatgttccataggttttaattgacttcagctacagcttcccggtaatgaatttactggatttgtatgtttcaagtaaagaaacatttttcataccattgtcattctatcaatatgatcatttaaatgatttaaaatgatattaggctgggcgcggtggctcacgcctgtaatcccagcactttgggaggccgaggcgggtggatcacgaggtcaggagatcaagaccatcttggctaacacggtgaaaccccgtctctactaaaaatacaaaaaattagccaggcgtggtggcaggcgcctgtagtcccatctactcgggaggctgaggcaggagaatggcgggaacccaggaggcggagcttgcagtaagccgagatagcgccactgcagtccagcctgggtgaaagagcgagactctgtctcaaaaaaaaaaaaaaaaagagatattaaagaagagaggcagcacttctgcagatattaaagaagagactgcagtattgctgcagtcattaactgatgtgtttttagaagtattttcttggtttttgcctatgagtgttctaaatgccaagcaaaggctctcctgcgtaccacttgcagcagttgtcttgtctttgacttgcctcaggattcctggtaatgaaattagcaaagtaatcctgacacccacttcctacacccaagggaggggaggaaagaggtatagtagtttctaaataggaactcccctaccagctttacaactaatcacttccactactgcttctttcccgggttggagcaggtgcccccctcccttggactcacatggtccccttgtataaccctactttaattcttaccacaaaattatttgacgctgtcttccctactagattgtaagcacttcagagacagtctgtctttctcatctttgtgttcactgtgcctaccacataagaggtgctcagtaaatactagatatgaacattgatgtgcaaaagctattcactaaggtggtatttcctaaatgttttgtcacacagaaatgtctttcatcttagtttagtgcatattcccacacatgtattatttatactcatatatgtgtatgtatttcaagtatatacaagtcctcattttacttctgatactctgatgctttctatattgaccaattttgttttttcaacaacactcctgattgtttcataaacctctttaggtcacagctcataatttgaaacactgctttaagttttagctcaatttggctgtaccttctccccaaactccttcctcaggaatagctcatcagcccatacactgtcagccatctgttactgtcacaagaaaatactctgcataggtatcttcctccttgaattacatataagtcggtaattgtaggttcaaataatagagtccagcttcagagggacgactgacttgaggacttctttgggtctgccttaatgagatgtgtctggcatagtgcctgctatggagtgtttgatgaatgctagttcttgctccatatttgggtctttcctcactggccttcttccttgttgctttggaagttggtttttctttttgtcttccaacatccagtccttgattttatgttcaaagggcttgttttactttcctaggtgaatgaaatcctgtgccgttcttcagtctggagtgccttcaaagatcagaaacatgatttgttcatttctgagtcacaaacagcaggatacctcacaggtaagccatacctaattggttattgtaagacacctggcagaagccacttggaccttccttttgccctaaatagacttaaaattgtgttcagagtgtttcttaggctaccagctgacctttcttggaggtgctatgagcatgtagtagacatatggtcttagctttatatagcatgcaaactgttgttgtgttgaatgggtactgactaaagcatgtattttgttcagttttgatccagttaattgggtcatagaatatatttggagcatgtctgtattaaagtatttatcttgtaaagagaaggaataaatatctgctgaggaatatcagtgtcagaaacatgattcatcattccatatctgtcagaataacagattaaaactccaaatatgtataattgtatgtaaaagatattcttggctgggcgcggtggctcacgcctataatcccagcactttgggaagctgaggcgggtgaatcacgaggtcaggagatcgagaccatcctgtctaacacagtgaaaccccatctctactaaaaatacaaaaaattagccaggcgtggtggcgggcacctgtagtcccatctactcgggaggctgaggcaggagaatggtgggaacccgggaggcagagcatgcagtgagccaagattgcgccactgcactccagcctgggcgacagagcaagactctgcctcaaaaaaaaaaaaaagatattctcctaagtttccagtgatttgtttatggttttgctaaatatttagggtgtgtcgttttatgggggtggaatacataggtatcatgaatgaaaggatgttttactgctttggtttcaaaagatactatgtttaaaactcagaacatttgacacactaattgcataattttagaatagtcattttcatataggcttcaacataagtcagactcttgctgaatgctaaagaggcaatatctagtctgctataaaagttcttaatttgaaattaaccttaggaatatgaggcggttcttgctgtctgcctgaaattgtagtatataaaaagatgtcagccctgcattctctcctaaccaaagatgataaactaagagaaaaaattatcacccagggtttctaagccattgtaattgttttaatcttgattgctagtatagaagtttataagatcatgaagactttatcttgaatattcaaaattagaggctttggaggaaattttacctggttttaattttaaacttggtgtgacacttttttttcttcaccataaccactttaatattgacactcctaaagttggagcagagtcctaaaatttataaacatgcagtgctttggctgcaggtcatgtcctgttcagaacagtgtcataggtttttattttaacttttccatcccctgtccctcatatctatggagaaaaatacctagactgtgttctcagtctgtcccatatctctcttcagatttggtgttaaaattatagcttctaagtaggagtttgttcttataggcagtataaaaactttacctctttagcctatgtccaaaagttcacataccacgttttcatggcattacattcattactttttgtataaggatggtatgattgaaaaaaaaatctgccttatttttattttattatttatttttttgagacagtcttgctctctcacccaggctggagtgcagtggtgcgacctcagctcactgcaacctctgctccctggattcaagtgattctcctgcctcagcttcccaagtagctggcattataggcttgcaccaccacacccagctaatttttgtaattattattattattattattattttagtagagacggaattttgccatgttagctatgctggtctcaaactcctgacctcaggtgatccacccacctcggcctcccaaagtgctgggattacaggcgtgagacaccacacctggcttttttttttttttttgcgacggagtctggctctgtcacccaggctggagtgcaatggtgcaatcttggctcactgcaacctctgcctcccaggttcaagccattctcctgcctcagcttcccaagtacttgggatgataggcatgtaccaccatgcccagctaatttttgtatttttagtagaggctggtctcaaactcctgacttcaggtgatctgcccacttcggcttcccaaagcattgggattacaggcgtgagccagcatgcccgccctcttttttttttttttttttttgagacagagtcttggtctgttgcccaggctggagtactacagcatgagctcagctcaccgcaacctttgcctcccgggttcaaacgattctcctgccttagcctcacaagtagctgagattacaggtgtgcaccaccattcccagctaatttttgtatttttagtagagacggggttttgctgtgttggccaggctggtctcggactcctgacctcaaatgatccacccgcctcaaatgatccacccgcctggtactcccaaagtcctgggattacaggtgtgagccactgcacctggtcagccttatttttcttaactaagagtaaattggccctgaagaatagtaatgtgtatattataagcttctctacaggaaagcctcttctaattcttctgttcagtcttatctatcattctttgacttaacttgatgaaataaaaaacatatgtccttgacttacagagtgtgaaccaaaaggtctgtggttagaatccagaagaaataggggtttatcttcagaaacctggacttcatttggtcctcacccccatccacatgctttagtaactatagggaaaaggtataggcagtaaaaagcttcttgtctgtgcctttccttttacttggatccatgcggtggcttctgaatgagatatgaaaagtggctgtgaaggggttagaagaaggttagggaaaaagaaaagttggggtatacaaatttcttcccatccctgagccggcttaagggacagcaagttctgtacaggtctggccaaatggggagatggtataaaacccaaccaggaaggggcatggagataatgagtcttccagaaggccattactgaagcctgcagacgtgtccatgtagaacagtctggataagctgtaagcattgttgaccccagaattgtgaaattctgagcatgttatcaatctgggatgctcttttttagcgatgtcagttgctggaaattttttcatcagctctagtctgtcctatttgaaaggaccaacttgccaggtgcaatggctcatgtctgtaatcccagcaattttggaggccaaggtgggcggactgcttgagtccaggagttccagaccagcgtgggcaacacggcaagaccccgtctctataaaaaaatacaaaaatttagccaggcatgttggtgcatgcctgtagtcccacctactcgggaggctctcttgagcctaggaggtggaggtcacaggtgagctgagctctcaccaccacactccagcctgggcaatagagcaagaccttgtctcaaaaaaaattaagttacattaaaaatgaaagaactatttcaagaattaaagcttctaactcttgctgtctgcctgaaattgtagtatataagatgtcagccctacatcctctaactacagatgatgtaggcaaattaagagataaattaggtaaatttactgccagttggattgatgtgtgctcattgcttgagttgccaaatgttttttgtgtttgagcttttcattgatgtattgtgtatcatgtgtttgataaaaggggcatgtagttctaataatgataaaatcccatgatgtggaactccaggaatttatagtgttgtgttgaattggaatttcatttagttaaaatgtgccccgtgctactcccaaacttcagaagatacagattgtacccagcccctctgtaatcattgaaatcaaggttgctgtgacaacacacatcaccaaccctttcttctaactgatatctttaggtgagtttggcaggttaggtggattttgtttaggacatggggaaagacaaaggagttaattactacttcaaagtaagataaaaatgaccaaaactacgttttcttctctctggctgctgagtaaatgtcattcagtcacatgcccaagatttggggtaaaaattttaaagtcctaggtaggattactcaatcttgataaatttaaatgagactgcctatttccataggttctctagcctggcatattttgttttatgataaatgcttatttaaaggtgcctcagtggaatttttcctgtgatgcagataaattgtggttactcattatccagggcccttgatcacttagccatttattaggttctagaacagcttggtgctgatggtctcagagcctcataaaaaataatttcagcagtgaaaatcctcaaattacctaacctagaaaatcagtagcaaaagaaggaacaacaggaaaaggaacagaggccagggtgaagatgcttctaggagccagaattggagatgaacttttcacatatacatttcatcgtggtagccaattcagttttgtgggattctctgtaaattttccatcttttctcatttctctgaagtccagcagccttgtgcaatcttgccacatgcccattcctggcagcccctgctcttcccatctttctctgaagaacacaactgccctattctgtgcaaatgaccaggcagcaccttttagccccaagaaaccagacacatcctcaaggagaggccagggtcctggggagagcatctcggatttcatttgtagaactatccgggaattgattttgatttgcctttcctaaagaggcaaatgatggtactaaaatttggtttcttccttctaagcccatcatttcaccatttagattttagctcagaggttcccacattttctcagttcacagtgcccttaatagctcagtaattttttcatccgtccccaagccaaaagaaatacctaataatttagtttatgaagtaattgcaagacaacttgaaagtagttgtttgtatggtggtcagcagatggcgctgtgtttcaaatttaaaatacccagcagttagctggatgatgtggcaggcaactgtagtccacatggacaggccgaatccgctactcagtaggctggggtgggaagatcacttgagcctaggagttcaaggcctggataggggagttgcttgagcccaggagttcaaggcaacatagtgagacccccatctgttaaatacacacacacacagaggggcaaagggaataaataaatatccagcaatgccccagggtgcctcagcacacagtttgagaactgcgtcattaatccactttctagatgcagcattcatggtttggtcttgtaacctactattttgatgggaaccaagttgagcccacaatcagaattgctcagaaactacacagtctggagtgtttgaggtcttactgttaagggttacatctttgatgacacctactggatggttttgcagtaatcatgctgcagcctaaagttcagagaatatgagggtggtgggaaatgatcacagggtgctgctgtagctctgaactgcgttgtcagaagggtttgttgacctggtggcctttttcctgagcagactgtgaaaggcctggcatcctgattggctcaaggcaggagttgatagatgcaggctcccacagtaccttaaaaaggagaaatattttttgtaagttctacaagtacaaggtttttataagtacagcgttccaagtacctgggcactctggttggcttcagttacagctcacacaggctgagtcatctctgcctatgtatctatacaagccatttcacatccatagtaccaatacttttaaggtcaaaaacaagatgaatctgaatggtggcctttttgtcctccaccaatccctgtttctaccttcatcaaactactctgctgtttgcacttcctcacaacttcccttgctgcttatatttcttttttcccctcaggtgtctctccttcccttctaactggcagcagcccccttcacctcaggagcgggctttagatccgctctgccaggcagcttgctaacttctgtgtagctctctgaagcaggtagagaaatgttttgctaaatgcatgccgctcccactgcctttctagtcctaaccctcaatgttccttagttgtttgccttgtttcctacaatttcagctaaaactattgctcagtatgcagtattatgctacagtgtcccttgcaagtacttgttagtttgtgcagtgcttctgagatgtaattaaatgtttatgcaatgtttaaaataaactctagagggctaaagccattaatatgcccataggacacatctcgataaatgctggcatatatggcattttcatgcaatagaaactgttagaatcaagggagaaatataagactaaaatatcagtaccctttcacatagcattcttgttttaacctatgacagatggatgtccagagccttttctttttcagagtccttggtttagcaacccttgttcgtttggtgttacttgttataatagcatttctttgcaccaaatgaaaataggttagtttgagtgttgacagaagtgtttatgttgaattttgtcacatatgacttttggatgagctgagtgtagagtttcttttgtctgtctgtttccattttttccattcgacatagttcttttcagtgctcggaattttttgaaagattgaatttcccaaatgtaagaaagaaaattttatccatatttccacaccagtgttactgtccagcatacattttgaaatgatttctagtctatagtgtaggcaaacatgaaaatagtactatgtagctgtttattaaggtatagatgtaatttaggtaattgaaatagatgattagttttgtgtgatggagtgcctgagcaggttctgacatttttataaaggtcaatgttttcacttgactgctttctagaggtgtgtgtttacctttctctcttgcaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgaga

SEQ ID NO: 14869 - DNA, 1805 bp, Homo sapiens
atggctaccaaccctgtgtttttataatgttaaaggactagaacaggtaaatgacattaatgttgatgagagtcaacatggtttaggttcctggtttaattttgttgttgtttgtatgattttacttggtttttccatagcctttctgggaaatataatttaggatctatttcttactccagatagaaagagataacagctttcataatgtggcagaagctacgtttacactcaagctgattcaatcactgattgcaagtggaatagcaggctctatgattggtgtgataacattatacaaatcccagatgtacaaggttggtattatgtattacagtatttgccatatattaaatattacaattacatattaccatatttgatattacatttatagtagttggtttggtgcctgaaaaacttttggtactgtaattaatatattaaaaaagaaacattctgatttttttctggtctggctttttttctgtataattaaatgtaaacctaacaaggtttaattaaatttagtttacagctgttgcggcaaaaatgcaaaaagcaaattagagggaagaaaatatggtgtatgctttgtagacagatgggactgaatctctgttatccaaaatgttcttttattattggtacattttatcagtaaatcaaggatagataccaaatattaatgtacacatgagccaattacttctaactagatttttctcttagtattttttatctgtttcattattagtttatcagctccaaattagcatatccaaatgagttacccagcaatagataaattgcttttgattttgtgtcataattaatatttttatctagtcatttatctatcattttagaaactagccaagtctatgtgagtcataaaagaaaaatgaaaattatttactattagttaaattacagtggttgctttgagcaggttcagaggcttaagttcttcacaatctcttactacatgattgctgttttttcttccacagctttgtcatttactcagtgctgtggactttcaccatcctgatattaaaactgtgcaggtgtccacagtagatgcttttcagggagctgaaaaggagatcattattctgtcctgtgtaaggacaagacaagtaggattcattgattcagaaaaaagaatgaatgttgcattgactagaggaaagaggcatttgttgattgtgggaaatttagcctgtttgaggaaaaatcaactttggggacgagtgatccaacactgcgaaggtaaaataaaaatgggtttaattcatgcatttcaagttcaaactgacttttatgggttaatgcttggggtgcttcaagcaggaacagctctgctgggggaagtaactgacatgataatattgggacctctgtaaaataaagaatagttgtctcatgtcgtatgtttttttaaggaagggaagatggattgcaacatgcaaaccagtatgaaccacagctgaaccatctccttaaagattattttgaaaaacaagtggaagaaaaacagaagaaaaagagtgaaaaagagaaatctaaagataaatctcattcataaaaagacatggtgtaaatattttgtatttatgtaaattcagactcattttacatgatatattttttatatttttattactctaaaccctcttattaaaaatatgatatttaaataacatagtaaacacatgtaaaaattttgttcttcaaaaaagtgtacaaaaggtagtataaaatcctactaataaaaataagcttttttctaagaagaatga

SEQ ID NO: 14870 - DNA, 1317 bp, Homo sapiens
ctgctgctcatttttctaaaaaatgttttattggaacacaattatgcccagttgtttacatatcatccttggctcttttcctctcataatatttactgtctgtatgtttataggaaaaggtttgctttagcttatgcatagacaattattttaatgtcactattaaaaataataatttcttaatagtttaaatatcacatttacatagattaatttccaatcatgcatattgttttgtaccactactatttgttttgttctctcatctgtttattcctgtgtcaatactgctcttataatacctttgtgtacatttaaaaccttgaaaagcaaattacttttcattatttactttcaaattttttctaggaatttcccatgcatttattttttacataaagtttagaaaaaaaatttccactttaaaaaactgagatcctgattactgttatagtaagatgacatatcggtttaaataaaattggaaatattgtgatattaaaagtcttccaatccagaaacatgctatgtctttctatttattcatgttttagtttatgtccttttataactttttatagctcttttcatgtaggcctactaattttaagttaaatttaatctatgatattttgtagtttttactactttttaaaatgagattttccttttgcatacctatttctaacatgaaattgttagcattaaaatctagctagtcaacttggattcagccactttaccaaattgctttattattttaagcacgtttttagtagtcttttatattttttaggcaagccatcaaatggagatatttttggtttttgactatgggaatagttactgttcctgttttttaatcatgatgactttcatatttcatctttgttactacgtttttacttggatattgttaattatacttttccatgtttagactgtttcttctattcccatgtcactatgaattttaattaggaatgtcttctaaattttattcaatacgattttagcacatgttgatataatcacgtattttttgcttttttctctttaatttgtttatataataaattatattgagaaatttacttaatgctgaaccagtagccatggagtatactttacttagttaaaaatgtgacattctaaaatatgatgctgtattattttgaatataatttattaggaatttttatatctatcttgaaaaagaaactggctatagctttctgtgatagctttatcaagttttgatatcttggtctatgtcttgagagaatttaaataaaggataattgctctgaacaaaat

SEQ ID NO: 14871 - DNA, 1317 bp, Homo sapiens; identical to SEQ ID NO: 14870

SEQ ID NO: 14872 - DNA, 1859 bp, Homo sapiens; identical to SEQ ID NO: 13031

SEQ ID NO: 14873 - DNA, 6410 bp, Homo sapiens; identical to SEQ ID NO: 12696

SEQ ID NO: 14874 - DNA, 407 bp, Homo sapiens
attttaccacatttgctttactattgtgtttgtctcttttttttgaaatggttgagaataagtttacagacatgatgtcccattgctaagtactacatggtgtatttcttaaaaataaggatatttttcaaaatcaggaaattaacattgataaaaactattttaagtaaaaaatgccttttttctcctccaagtcaggaatctaataccaaaatcatgttacatatagttgtcttctttcatcttttttaatctggaatggtccctcagtctttctttgtcttttatggcctttaaaatttggagaatacagaacagttttttgtttatttgtagaatgtccctcaattttggtttgcttgattttttgggaattagattttggctatgctgtgatcatatcagga

SEQ ID NO: 14875 - DNA, 1299 bp, Homo sapiens
gagatcctgcctcaataaataaataaataaataaaaataaagtaaatggaattacacaatatgtgcttttggtgactggcttttttcactttgcatgttttcaaggttcatccatttgtttggtgttttaaatcttatgtggttgagtttggtttcatgtcagtgtttatttgccttttgttttcaaagataagaccacttaaattattagattatttgaattctccttaagttataagtctggtcctgctatatcagttatctaagtatttagaaatggtagactaggggacctaggtttcttaaacttttctctcttttacttaggtgtgcaatatgaataaaatatcagtagatttgtattttagaaaatggggcatacaagattgggggctttattgacacatttaattctttcatgtgtaaaattacttatgtgaaaatgtgattttcttgttttttccccagactaaaaagtttttgttaattattatgagtatttctatagttggctgtttttacctggcaagaatgcttttctgctcagatgaagagataaaggcattaggcctgggatggacatttctgagtgaattaatgttggattggtattttttttatgagtggaagagacaaactatcttacatccattggttttaaaacattttttaatttcagtatatatatgtagagaaaagtacacatgtcataagcctatacagctcaatgaattttaagaaactgaacacacatgggtaactagcacccaaatcaggatatataaaatgttccttgcattccaaaagccttcttttgtgcttctttccagtcattatcctttctccccaaaaaggagtcaacaccctgatgtctaacagtatagaatagtttagttcatccatggatgcagtgagccaagatcacgccactgcactccagcctgggtgacagagtgagactctgtctcaaaaaacaaacaaacaaacaaaaaacaaaccgaaaatattagtctgtaaagattgatcttgagcctaaacttttagatgttttctatcctttgaacaaatgcttctgtatcttaagcttggaaggacactgggaaactaaacacttttaaaaggcacttttctttcaatagcccacttataaagtttgctttatctaccagtacgggggaaaaaaagaataaagttggttttattccatttaaagtagttttggtatttctttgctccataccaaagtcttcctcccccaaaataaacaagtgaattagaaccaaaaaaaatcaagaaaaa

SEQ ID NO: 14876 - DNA, 1381 bp, Homo sapiens
aataaataaataaataaataaaaataaagtaaatggaattacacaatatgtgcttttggtgactggcttttttcactttgcatgttttcaaggttcatccatttgtttggtgttttaaatcttatgtggttgagtttggtttcatgtcagtgtttatttgccttttgttttcaaagataagaccacttaaattattagattatttgaattctccttaagttataagtctggtcctgctatatcagttatctaagtatttagaaatggtagactaggggacctaggtttcttaaacttttctctcttttacttaggtgtgcaatatgaataaaatatcagtagatttgtattttagaaaatggggcatacaagattgggggctttattgacacatttaattctttcatgtgtaaaattacttatgtgaaaatgtgattttcttgttttttccccagactaaaaagtttttgttaattattatgagtatttctatagttggctgtttttacctggcaagaatgcttttctgctcagatgaagagataaaggcattaggcctgggatggacatttctgagtgaattaatgttggattggtattttttttatgagtggaagagacaaactgtcttacatccattggttttaaaacattttttaatttcagtatatatatgtagagaaaagtacacatgtcataagcctatacagctcaatgaattttaagaaactgaacacacatgggtaactagcacccaaatcaggatatataaaatgttccttgcattccaaaagccttcttttgtgcttctttccagtcattatcctttctccccaaaaaggagtcaacaccctgatgtctaacagtatagaatagtttagttcatccatggatgcagtgagccaagatcacgccactgcactccagcctgggtgacagagtgagactctgtctcaaaaaacaaacaaacaaaaaacaaaccgaaaatattagtctgtaaagattgatcttgagcctaaacttttagatgttttctatcctttgaacaaatgcttctgtatcttaagcttggaaggacactgggaaactaaacacttttaaaaggcacttttctttcaatagcccacttataaagtttgctttatctaccagtacgggggaaaaaaagaataaagttggttttattccatttaaagtagttttggtatttctttgctccataccaaagtcttcctcccccaaaataaacaagtgaattagaaccaaaaaaaatcaagaaaaagaaaaaagttaataatttcttctagttctcagagttttatataagactgtacaaaattatcgtcatttagaattttttttttcaccagccctgaatttt

SEQ ID NO: 14877 - DNA, 7301 bp, Homo sapiens
attattaattagatggcaccagtttagctctgtgtaaacttcaatctactcccaagtgcatgtaattcttccaaaaatatgggggaaaaataccttacctgaagcttctgtgggatttacccacttgcttcttgtcttgttcacctgacatttggtttctgcttgttacagaaaagaagaggaaaggctcaaccaagagaaaaaggtctctgtttatttagaagacacagactaacaattttagatggtaaggttcacaaataggttgatttctttcttcagctttctgacatgtccagcccatctctaatgaggactcccagatcatcactttatggctgttaggtgtttcccatatgaaattagaggagctgggtcagggagacaaaagtcttctattagtcttatggatagctcctccttgagtgtattttgtgcaaaagattaagaagctggactctactgccattaaagctgagagaatcctaaggttatttgtggcttcggggttatatttattactactactactaataaatattcaacaagtaaataaatcttttttaaatcaaaagattagtatctgcttattctttttttttaattgtaaaccaattatggtattaagagagtgactcaatagacatatctggcagtttttacaggagagcttttgtactatttggaattgatttcaactcctctcattagttattggcactaataactacctgaaatgaatccagttttagtaagcatataattttatttttccagttttcaggttcatcaggcttaaaaagtaggataatttatttttcttgtctttgtttttgagacagggtctcaacccgttgcccaggctagggtgtagtggtgcgatcttgggtcactgcaacttctccctcccaagctcaagtgatcctcctacctcagcctcccaagtagctgggaccacaggtgcgcgccactacacccagctaatttttgtactttttgtagagacggggtttccccatgttgcctaggctggtctcacctgagctcaagcgatccacctgcctcagcctcccaaagtgttgggattacaggcataagccactgcgccgggccaatttatttttcatatgctcagaatttctcccattctctgaaataggtccacacatttaatttctagatgttataaatccggacatgcaaacttaaattttacgctcataagaaagttcttgatattaatgactttatcctgtaaaactctggctctgttacacggaagaacattttttacagaccgttattagttgcaaagagggtcacatttttataggctaagctccagtgaaagacctcaaggatttataaaatagaatatggagtaaaatgattgtattgtaaaaccagaaaaccaaaattaacattagggagtttttaccaaccaatggctattgtctttttaaagttaaggggattatctaacaacttggggtcatggaaaataaatatgggagatgttttagatcaaaagaaacttaagagatgaacacaatcaaagtgcaatgtgtgatccccaactggatgaataatagtgtgaacaagctagttgtaaaaacaagcttagaggggcaattgggaaagtcttgaatatgaaaatgttaaatatatggataatattagggaattattgttagtttgtattaggtatagtgatggtattgtagttataaagaaaatgtacctattttgaaaaattcttactggagtattaggggtaaatgtcagcaatttactttaaaagcatatgaaaaaaagcaaataaaacaaaaaaggcttcagaattaggtgatgggggagatgaggggagaaaagaaaagaaaagaatgaattaatgaatttaagggatgggtaaattccacatactctgttctctacttttctatatgtctgattttgtttgtaatgagagtgagaagtggggagaatatgggatgtatgtgtgtgaacaagttgtgggtcatccaagtgtccatgcaaggtacttagaggccatgatttaaggatactaactctgaaaattatgtaataaggattaggaaacttcttttaaaaattaaattgggggagaatatgaatactttccctcagaatattttccttctaataacatatatgtaattcataatgccaagtattcctattgtactcttctcaatatattatccatttaaacttttgttttgtgttttaggaagctgagatgatttccaagaacaagaaccctagtatttcttgaagttaatggaaacttttctttggcttttccagttgtgacccgttttccaaccagttctgcagcatattagattctagacaagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagacactacttacagtgttatgacttgtatacacatatattggtatcaaaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgatagatttttgtcgttttgttaattaatccaagatttacaatagcacaatgctaaatcacacagtaactacaaaaggttacatagatatgaaaagattggcagaggccattgcaggatgaatcacttgtcacttttcttctgtgctgggaaaaataatcaacaatgtgggtctttcatgagcagtgacggatagtttagcttactatgtttcccccccaattcaatgatctataacaacagagcaaagtctatgctcatttgcagactggaatcattaagtaatttaataaaaagattgtgaaacagcatattacaagtttgaaaatccagggctggtgaaaaaaatcaactctaaatgatgataattttgtacagttttatataaaactctgagaactagaagaaattattaactttttttcttttttaattctaattcacttgtttattttgggggaggaagactttggtatggagcaaagaaataccaaaactactttaaatggaataaaaccaactttattctttttttcccccatactggtagataaagcaaactttataagtgggctattgaaagaaaagttacaagcttaagatacagaagcatttgttcaaaggatagaaagcatctaaaagtttaggctcaagatcaatctttacagattgatattttcagtttttaatcgactggactgcagatgttttttcttttaacaaactggaattttcaaacagattatctgtatttaaatgtatagaccttgatatttttccaatactattttttaaaaaattgtatgatttacatatgaacctcagttctgaaattcattacatatctgtctcattctgccttttatactgtctaaaaaagcaaagttttaaagtgcaattttaaaactgtaaattacatctgaaggctatatatcctttaatcacattttatattttttcttcacaattctaacctttgaaaatattataactggatatttcttcaaacagatgtcctggatgatggtccataagaataatgaagaagtagttaaaaatgtatggacagtttttccggcaaaatttgtagcttatgtcttggctaaatagtcaaggggtaatatgggcctgttgtttagtgtctccttcctaaagagcacttttgtattgtaatttattttttattatgctttaaacactatgtaaataaacctttagtaataaagaattatcagttatataatttgtgtatatacatatctagaagttctacattgcagggaaaacagatggatatatatttaatctttaccaaaaagttttcttagtagagacaacctgcaagtcaataatggatacagttagtttctaatgggtaaacagaagtatacggatttccacagaattttcacactgttttggatagctgggaattgggcataacaacactacttagtttgagggctctttcaaagaaaagtatcaaagattctatttagtactttgcattacacttttaatagggaaaactactggctttcaagtctagtaaaggaatggaaattgaaaaatggaaacttattaattcttccccaaagcgaaagcatacttttattctcctgctttcattgacatgtggcaatttccagggaagaggcttactgattattaaagcagtgtacttattgtaccatctctttttcagaagtatgtgacgccatctcacttcaagtactgtgataacataactttcttacttttccaaccaaagacacagaaatcccagttcctcttttcctctaatacaggctgtaatgatttgatcatcattgccaccgccaaaagtaatttaacaaacacccaattttggaggctgcaatacctacactaaaaaggacaccaaccaatgaggcttgtggcacatatcactacaagcacctaatatatatttatctatactgtatgatctcccaggtgtttctgaactctaaatttacagtagtgtattctgagaaccttcaactaaatctcgagacgtaaaaacgatgtctgacatgcagtcagagcatcaaaattatttagttctgcagaattccataaaaacaaaattgtaattattccaagtccgtagcctacttcattttcaagcaaaagagagcatttagctcccgcctgaaagttaataaatctctggtcagtgaaaccaggtgtggttctggaaagaagccaggttcctatggtaacttcggatcgccatttaagttgtctctcggcctcctgctctgacgtcacttccggtgttacctgtgtcgttaccgggagctgtaaacaaggtgtgcaagcatctgaagagctgccgggatgcagcagagaggagcagctggaagccgtggctgcgctctcttccctctgctgggcgtcctgttcttccagggtgagtgctccggctggctacgctccacttccggccggggggttagggaagatggtcgcttttccggttccgggtaggggggtctccagaaagcccccgcatagctctgggaaggaaggagggagggagcgggacgttgggacgatgtcatcaccaccccgttgaggatagttggtattttgtcagtcctttcctgagccttgggagctttttcaccttgcgtgacctgtcattgtagtttggtgatagcatacttgatggaaccacaaagagctctggctttgggggcacccggtgttattttgtggtgttattatcagtggttgaccgctgtcgtttgggcgctgtataccctgattagaaagaaaacggttctagcattcagtagtttgccccagtagttttgggaaacaaaatcatgacagttggtaattttattttttgtaggtgattattgtagtctataaaatgaaatatttgctagtcacagaagggatgtgatgtgattcgttatagagaagaatatcgatgaaaaagtaactgctttagcattttcataactttttttaatacaagaaagagcatataaattctgttaaaatttattaagtaatatcagaagtagggtattcacactgacattcacatcttaaaattaggtgagttttgctttcatataattttcaaattgcataaatttcaatccagcctaattaccttcatcttaaggtacaattatttcctggattttgtgtatgtgtgtcttcctgggaaataaaatattagtatatctagtattagagtgaattgctaaatttataaaatttccttgagggtaatggggatttctgaaagagatatttaatattatataaatataaagactttaatataaagacttcagatgtcctaaatcttagcagttaaggctggaaagtttttaactggtgactaatattcatgttgccagcacacccccgatccctcccagctgcctgtgtcatcataagtctccagtttttaagctaaattactttgcagtatgatatttaggctggcctactgtcactcctaataaacccagtcctctctctctctctttcacacacacacacacacacacacacacacacgagaaatattcaaatattgtcttattgagaaaaaaaatctggaaatggtgttttcttaaatctaatgtcatgttgctttgaagagcatctgtcaagtccagcagaccatataattcaatcaaacatttaaagttgattttacaatctctatgtacttgtggaatagattttttgccttttaaaaaataactggtggcagggtgtggtggttcttgcctgtaatcccagcactttgggagaccgaggcagctggatcacctgaggtcaggagttcgagaccaggctgaccaacatagtgaaactccgtctctactaaaaaatacaaaaaaaattagccaggcgtggtggcgggcgcctgtaatcccagctactcgggaggctgagacaggagaatcgcttgaacccaggaggcagaggttgcagtgagctgagatctcgccattgcactctagcctgggcgacaagagagaaactccgtctcaaaaaacaaaaacaaaaacaaacaaaaaagaaacaactggtttatcatattattcacatgccatacaatttactgtcttaaagggcataattgaatggtttttagtatattcacagttatgcaataattaccactatcaattttagaacattttcatcaccccaaagagaaacttgatacccattaacaatcactcctcactctccatttcccttagcccctggcaaccaccagtctatttttttgtatctattgatttgcctattctggacatttcatataaatagaataatatctgtaatcctagcactttgggaggccgaggtgggtggatcatttgaggtcagaagtttgagaccagcctggccaacgtggtaaacaccctatctctaccaaaaaatacaaaaaaaaaaaaaaaaaaaaaaaa

SEQ ID NO: 14878 - DNA, 115 bp, Homo sapiens
gggcgcggtggctcacgcctgtaatcccagcactttgggaggccgaggcgggtggatcacgaggtcaggagttcaagaccatcctggccaatatggtgaaaccctgtctctacta

SEQ ID NO: 14879 - DNA, 114 bp, Homo sapiens
cacgcctgtaatcccagcactttgggaggccgaggcgggtggatcacgaggtcaggagttcaagaccatcctggccaatatggtgaaaccctgtctctactaaaaatacaaaaa

SEQ ID NO: 14880 - DNA, 13928 bp, Homo sapiens
acaagagagagcccagagcttacgtttgagaactatacgttcttcatccattagttatagtcaagagtctggagcagcaggtatttatgtctaattttttctaataaaatatttgacacaaaacactagttattttaactttttaaagttaagtattcctgttttcctttcacttgccgaaagtgtttttaagtgcatttctatcccagaagcactcattctttcctatggaagaaagtggttctgaaattagaaagattatactgtccaggaaaaaaggaagtgttgtgatgatttatataactgatagccaaagatagtctgaaactgttgattataaaggtatctgtccaggtatggtagctcactcctgtaatcccagtactttgggaggctgaggcgggccgaccacttaaggccaggagttcgagaacggcctgggctacgtggtgaaaccccatctctactaaaaataatttatattcctgccagcagtgtattgagataatcatgtactttatgctactagaaaaaaagtcacatgaaattttaacacagaatgttcgacatttaatacttttgtaacataaatgtttttttatacttgtttgctgattgatttgcttctctttcctaaagatttgtggaactcagtagtattagtgttaatttgtaggtatgggtccagaagcaattcagagaggacctgaatatacctaaactgttccctgaagagtcagcagtagccattgggtagttcacttggaaatgatattcctctcctccaagttgggggtgtgtatttattggtcacagaacacacagtcatacagagcaagagagaatgactctggaatcagactgcctgaattcaaatcccacattctctacttactccgtgagcaatcctgagcaagttacttgtctcatctttaaaataaagatactggccagtcacggtggctcatgcctgtaatcccagcactctgggagtctgaggcaggcgaatcacttgagatcaggggttcaagaccagcctgggcaacatggtgaaaccctgtctccactaaaaaaatacaaaaattagctgggcgtggtggcgggcgcctgtaatccccagctactcgggaggtgaggcaggagaatcacttgaacccaggaggcagaggttgcagtgagccgagattgtgccactgccctccagcctggatgacagagtgagactccatctcaaaaaataataatgatgataataataaaataaagatactaataatgcttatgtccatatagttgaaatagttcctggctcatagtaagtgcttttgctatatgaggtaggggaccttagagaaaccacagtcactttctagagatttaagtatgtctgggctatcattaaattaaaaaacgacagaaatggcttttattattttttaaaataaatcatgatttagttatccaaatgaatattggtcttcctcaacgtagtcaccatgggagtttttgtgtttatttcagcagtgcttccctggaatgcctcattggcataacttttaggatatgtcagcttagtatcagtttgatttctgagaatgactaaaagttgctttagagccaagtctagcagctagagtatcataccaggttggattattggtttggtatagatgcaaagtaagatgtgactatatgatcatgagtgatttttcttttatctaaaggagctttgagggtaattatgaaagaaaaccttaccaaatgcttttagccgaacaataacattgttggaataaatagtctcaaggcgattgttttaaaaaaaaacttcatttggaatttgttccatgtttgtttaaaaatcttggctgggcgcaatggctcacacctgtaatcccagcactttgggaggccaaggcaggaggatcgcttgagcccaggagttcgagaccagcctaggcaatgtggcgagactccttctctacaaaaaatttaaaaaattagccgggcgtggtgatgggcatctctggtcccagcaagccaggaggctgaggtgggaggatcgtttgagcctaggaagtcaaagctgcaatgaaatatgattgtgccactgcactccagcctgggtgacagagtgagaccctgtttccaaaaacaagaggaagaattagaaatgcagtgagggctgggcgcagtggcttatgcctataattccagcactttgggaggccaaagcggccagattgcttgagctcagaagttctaaaacttcaacagcctgggcaacatggtgaaatcccgtctctactaaaaatacaaaaattagccaggcgtggtggtgtgcatctctagtggtgtgtgccagctacttgggagattgaagtggaggattgcttgaccccaggaggtggaggttgcagtgagctgccattgtgctactgcatgctagcctgagcgacagaacaagaccctattaatttaaaaaaaaaaaaaagtgtagtgaacttggcttctcgcagactcgtagaaagttaaaaaggaagctaccatctaaatggttttattattattccagatattttggtattgttttctgtatcatgatagtctaaaaaactagttttacttttaatattaattggtataataattagttgttttttttccccagtcactgaagatgtgtgcttagttacataaagtacattaatatttgtgtttataaaataatacaatatttatagtataatgtttatatatgtgtttaaattgtgacagcactgcatccacttgaggctcttttttatagctactaggaggtttaggcacttggagttaaattttaaatgaaccacatatttttcatttttgttaatgtagttttcccattttatgcaaataaaatatttaattggctctccactcctgcctctgtccccttaccgctaccaccctaagagattatcattgttaacatttgaggacatggtgttttgtaacctgttgttttttcttaatatgacaatggcccatattttagcagtaaacaaaaagatacagaagatgaaagcttagccaaacactgtaaatagaaatgggaagctttttcatatcggggaacggtggcttaattgattcttggggaatgggggatcaactaaccataaacaatttcatttaggatttttgcatcatgagggtatttggagagaaatatatcatcctataatgtgcacagtaagtttttcctaatttgttgctttgaggaaagacacaaagcaaactaaacagcctttcatagataaataagtatacagagagtgaaagatatgggtacaagtatatagagacctatcaaaaatacattgcttgtggtattaattctcatgtgtgattttagcatattaaaaggctgttttgtgtttttagaaccataagaataaatggggatgttacctttcagtttgttccaaagattgcatgcatcattaccaaagcttgagtctttttactcccctgtcttgttgagatacctactacttgagcatactctggaatgagaaagtttatcgattaacatgctgcttacgcagataggattagcatttccttaatttagtataccacgtgttgtatcaggcataaaagccagctttttttagtcataccccaatgtttaaaattgttaaatgcagacttcatgttcttttgatcatttaaatcatgacatggatatttttaatttttatattctagtaattatcaattgtcctggtctggctgcttagagtatcagtttgctcaaaattgcttgaatcattaaagcaaatactaattgtgagcattgaccagatcttaagttaaaaaaaaaaaaaaagcatctttggtcctagaagaagtgctaaggaaacctgaattaactgataaagcacaggtaaagtttgaccataaaacttgtagaaagaatggaatatagcttaatgcttataatgtaagacattggaacaaatacttaaattcagtggttagcactataaatatcttttcttaactgtgagtagttggaaaatatagctggctaatagtaattacaagttactatttaaacagatgccaacatgcaaagtagttgtataattttcctaaagttatgttacacttgattttaacttgacgccattgtgcattgtaaccatattattatacaaggagcatagaccaacaacagttgagtaaatgggtgaataaatgaataaaaaggataaacacaactaatttaaaagtcatgagcataactaacaatgattgcttttattctgaaactgttttccatggtttataacgttcatagccatatgacccttccttaatctcttccttccttccttgtattttgggtactgattctttgcaaggtccatctctcttttgtgtgaagtaaaatactgggaaaaggctgcttttctaaagatacctgttttgctatttttatagtgcttataactgatgtaattagaagaaataaattcatagtgctttggatatagcacctcagattaatatcaaattgtcacctcctgttagtgttcattcactaaaggaatagtgtacagaacgtgtacatttgaattaagggaagatggttagaaaagttctggaaccgggaactaccattcagaagacttctatgggaccaggacaaagacaaactttacgtagttcacaatttgcctagagctgtccttgattctcctttctctttttattctttttttattctttgttctcattgttttactactatgttttaaaaatgtttataacttgatattttaatgtaaagtatgttttcttagaagggaagaaaaaatgctttatatactaaaaacagcaggctgaagctataagttaacaaactacatcttaagattttttgacagtgctacaattggtaaactgctagaagttatttttagaccagttttatgtacttaatagatttctctgtgttcccaatagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaaggtaagcttatagaaggagctatttatatgtaaatgtaattttatattgtaagacaaaataacttgtcttaaatttgggttttataagatacttaaagggattggttttattctagttaaataaatttaaaagaaaccaagttattatgctagtcatttggaattaataactagtcaaaataggaaatggatatttcctttttttgtttttgttaaactagaatgctagtaagtatgtaataccctgtgtaattatgctagacccataaatactttcatttaattttcccatacataaattttatcatttaggcacagagtgagtttatgatataatcagataattgatgcctaaaaatatgcatgttttgcattagtttactattaaaaaactgacttaagggtttgaggataatggaggactagggataaatttttaacctgaatctcagttatcagtatcttgttaatataatttacagtggttcttaccttatacttcattgaattttcccatacataaattttatcgtttaggctacagagtgagtttgtgatataatcagataattgatgcctaaaaatatgcatgttttgcattaatttactattaaactgacttaagggtatgagggtaatggaagactagggataaatttttaacctgaatttcagttatcagtatcttgttaatataatatagattaaataataaaatataatataaaataagatatatcaatatcttgttaatataatttatagtggttcttaccttagtttaatgaactcagaatttaaaggggaaaaaagctcctaactatgagaagtttttaaaaatagtcattgttttaatatagtgcactaatttgttattgtggtgttttgcagcagttatttacattataattttttccgttagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaaggtaaaatgcatacttcttgttagtccattatcttattctaaatctttaggtgtattcttttagtattgatgatttttgggtttttttttttttttttttttagacaaagggtatctttagtttcttcagtataaaacagttactcttttttcataaatttttagtgtttggcaagcatatataaatacgtataaagcagacttgctttaaaatgttctgaatctgaaaattttagtatgtttgtattataaaactttgagtataaaatattgaaggatacacacctgagatttttctcataggtatatccttgtaaggtcaggtctatgagatctttttaatgaaagttaatagctaaataacacatgccctcaggcaaagaataattagccagttcttgaattatttctgctgtagttcaaagctttttttttggattactgcttttaataaatacactattttgcaaattataacaatcttgtgaaagtccaaacaccagtgactaccactggcctctaattgatgaattatatttcattagctaagcaaatagttcttttgttaagggttaatgggataatttatgaggtcctaagaagtctgttgttgcctaaattaatagaatctctggattgagaagtaactttcagtagaatatagctaaaagaaaaaaaaaagaaattttctttggtatccaagaagatcaaaaaaattaaaactttttttaaaaaataaaaagaaattaatcccaaccttgtacccaagcagaacaaaggatagcaattttcaaaaagggaactaacaggccaggtgcggtgcctcacccctgtaatcttagcactttggaaggctgaggctggtggatcatctgaggtcaggagttcaagaccagcctggccaacatggtgaaaccccatctctactaaaaatacagaaaaaattagccaggcatggtggcaggtgcctgtaatcccagactcgggaggctgaagcaggagaatcacttgaacctgggaggtggaggttgcggtgagctgagattgcaccattgcactccatcctaggcaacaagagcaaaactccatctcaaaaaaaaaaaaaaagaactaacaagctgggcatggtggcttactcctgtcatcgtagcactttgggaggctgaggcagaaggatcacttgaggctgggagttcaagaccagcctggacaacatagtgagaccccatctctcaaaaaaatttaaaaattatctgggtatggtagtatgcacctgtagtcccagctacttgggaggctgaggtgggaggattgcttgagatgggcaagtggaggctgcagtgagctgtgattgtgccacttcactccagcctgggtgatagagcaagatcctatctctaaaataaaaaaaggatctaaaggttgtcatactgtgtcataggtgttgtatgtacttttacttattttaaccctgcagcaacctcgatatttcggtctctgtgtgttaaaatattgagatttaggaaagtttatgtaatatatcttcagttacacacaaagaagcagagctgagatttgaactcagatgcatgaattcttaatataagttccatgattaagtttcagtagctatttgggaactcagtcatggggaaaccaccaactcatgaagcaatccattctgttgtaaaatggctactaattgttacaaaattgttacgtttgagtcagatctgtttccttttgtttcctttatttctgtttctaacttctgggacccgactgggaataaggttgatcttcttctgtaaaacagctgaattttttatattcaacatacattttataatcagaaaaataatatatactatttcttaaaaattagttttggggctgatgacaaacatatttataagtcacatatttatttctgaaggttttaagtgagtaaacctggactttaaaaaatgttgggccatgtgtggtggctcatgcctgtaatcctaacacttggggagggtgaggagggaggattgcattaatccaggagtttgagaccagcctgggcaacacagtgtgacaccttgtctctacaaaaaactaaataatcagctgggagtggtggtgcatgcctgtagcccccgctattaaggaagctgggatgggaggattgattgagcccgtgaggttgaggctacagtgagctgtgatcgtgccactgcactctagtctgagcgacacagagagaccctatttccaaaaaagagagaaaaaataaaaaatttcaaaatatattagctgatcgtaatttttcatgtagttattcaaagcaaggctttgctgaaaacaaaactattcagatacttagaagggaaagagagactgttgtaccacatgtacctataaatcatttatagagaagagattatttacctcattgttcaggtcatagggtacagttacagatctccttttttcaaacatgtacccaaagggttgtaaatgaatgaattagttttccattgaaataatattctgtggtgctttgggatcccaaccagcctaggaaaacctgctaagtcaataaagtacccaaaagctgagccttcacttaacaataaaaagtagagaatgtggcaaaaaatagtaaacagaaaaattaagttgaaccagaaatagtgggataatgtgatcactaatcaaacattggtgcttgaggctgaaaaattttctagaagactcctttctcttggcagcctgcctttgcaagtctgctccatcagttgtgccttttctcttcttcagtgctaagtttcccaggaatgggagtggggaggagcaggaattagctgcagtgctgaaggataatgaaaggtaccttgggaaggtctaccatctctgcctgcatggactgtgtagggaagtgaggaggctcattgacaaggaacctctagtcaatgctgggaaatgggattctgactaggaaatagaaaggtttcttgtcccatacatgcatcacccacctcccaccccaacctttctactgttttccacaacactcatcgtactttacagccttccaaaggccaaaggtgttattataccatgtaataatagattattttataagtcccatctgtagtattgtttataagtcattttattttagagagtccccatacttttgaggctgttttgaatttgttttggaacagagggggaaaatgtgccatattagcccttgcaaaccatgaaaataaagatctcaaagttcatataatttcacaagccagtttttaatcaccgcttctatgatgatatcaaattctacttattaacacctgtcctgtacagagattgctgagtgaattcaatcctgtcttctggtagccattatttatcatcttttttctttctctgccatttactttgagctataaatgagagccctggaatttgagtcatttgtcaatattgtcttcataaaaaggatctgagaaaaaaataatactgtttattcatacttgtttattagaactgctttttaaggtcaatttttaaaaagaaaccttccctagaagccaatttttaccatttagagaatattctttagaaagaaacctttagaatgctggaagtatcctgttggtgaaccatgtaactcataactgtgttgaaaataataatcttaatttcttcctctttgctcgatacataattacactacttttgattaagattataaagatgacttttactcagaacttttaagcacaaagtaaaatccattaaatcactgtcttaagcaaattaataaggagcaaattatttgtgagaatatataatagtttaaggacactagtaggtttaccttgaactaagatactcagctacgaacttctatgaaaaatcactttagcaagtatagatctttttcaactaagttaaattgtaatgtattttctctttaatcccccacccctatttttattaattcaagattcacaatcgctatgaaggcaaggatgtttcaaagcacaaacggaatttggccatagcaggtggtgtaacgttgtctgtaatcgtgtctccagtagtagctgcagtgactgtaggtaagaaaatgctgaaaagtactaattacctacaattttatggagttaaagttttgtggaaggattttttttaattgttttttaatttgaggacaatttaaattgagcctgcagtaagtcttggttgaaagtattacagattcaagagcctagccttaaagtagttggtaaattgttagtggctgatacccttcctccccactccaccccaagtacagttcggaggcctggcacttcaaaagaaaaaagtttgcatctctctctttttccccttatgtgcattacctgaaaggctgggaaccttgaatttgcttaacaactgggtaaatctacttttggcaaatgttccagccaactcttcagaaccctggcgcttttctctgtatgactctcttgaaaagactttctaaaactcatgtttctgtgagttattttgttgttgttgtttgtaatgactgatttaatttctctttaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtaggtaagtcctttaagcaaaggaagaaaatgtgcttattaacagtgtaagtagtggggaggccagagataacatgcaactcagaatttccattgccatccttttactaggcctaatagtattcattcagaagtacataagtgaataaactgccaaggaggagtgtatggatgaaagaggtgggggtaattctgggtatctgacctctaattggaatataatgtcttagaaatcataaacttttcatcttaaattttgcctgaaacattataaataactaagtaaaggatatgaagaggaatacagttaataaaagaaatacggatgaccaataatacaaaaatatcttcaactcaatgttattcaaagaaatgtgaattagaacagtaacgagcaaagattaagaagaataaaaaagccttcatagactgcctataggagtatgtcaataaaccttttttaaaaagtgcatgttctatattctagcaattcttgttttagaaatttgtcatagggaaataattaggcagatgtgtaaagataatgcctactttcttacctcttattttctcttgaactggcctcaatcagatttttgtccctaccactccagaattttatttctgctattcactgaagcagagtcaccagtggcctccacgtaacctaatacagtggtcaggtcttggtcctcatcttaacagtatatccgacatggtagagactctacccttcttgaaatacttcacttttcttatgggaaaccacttcttaccatatttcctggccagtccgtctcattaatctttgctggttcattttcctcttctgacctctaaatgtttgttccccagagctcagttctcagaattcttatgtatctacacttttcccctaatctcatctattaaataatgcatagaccgacctctcccctgaacttcaaacttgcatgtgtaactttcctctttaatctgcacttgagtgtctaacaagaatttcaagcttaacttgtctacagccaaattcttggctctaaaatctcttcttcccttcatcctccttaactcaataagtagcttctccattcctcctgttgcttgggccaaaaaccttcacttaacaatgcctccctcttttccctcttgtcctacatctgattgatctgtcagcaaattctgctgcttccttcaatatttagccataatccagccacttcttactctcttcgttgtccttcccttagtccaagctaccatcctctttcctgggctattgtaatagcctcttaactgctgtatcaacttctcagcttctattcactagtccatagtgcagccatagtcacatgtctaaaccctgtcagattataactttcttatgctcaaaacttccccagtggcttctaactgtactggggaagaaaatccaaagtccttatcatagcccaaaaggccccacatgatctgccccaactatgtctctgagctcatctcttgtcaccctcttattttataccactcttgcttgatttttgagggtgccaagcattatcctacttctaggcttttaaactggcagttctctgtctggaatactctttccctagaaaatttcatgactcactgttttacttcatttgtctctacaagtattaccttatcaaagaggccttctgtcatcacatcatataaaatggctcacagacatgtacgtacatgcacttttcatcactctcctcccctttactctcttgtatttttcctcatagcatttgtcaccgtgtgattgggtatataataggaactcaaatattggtgcaaataagtgactccttaatacaaaatgtgtgagaggtactgtaaaattggaacatagtgttatcagatcttaataatagcttgtagacagaactgtggcatatatctagaaatcaacttttagcctattcttactgacctagagaataataagctctttaaatgacacccttaatgaaaactgtcacataattttcctctaaagtcagcgatattttttaacaatcatattctttatagaattcctaaatctgggtttttgaaaaaagaaactagtgaccatttaaaattgttggctctattcccactgcttctagtggactagcctgaaaaaaatatttttccatgtctgcgtatattttataccttatataatgtcctctctgaaatcatggaggaatttaagaaggagaaaattgataatcatacttacttagtttctttggaatatttgcatttagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggtgtgtgttttggtttggtttggttctgctttctggtaactacaaattattaattaggtgagaattttgaacataaagcatgatgattatatataaccctactatgtcaaggttcaaaatagtaatgttaaaaatgaaatttggggccaggtgcagtggctcacgcctgtaatcccagcatgttgggaagccaaagcaggtggattgcctgagctcaggagttcgagaccagcctgggcaacatggcgaaaccccatctctactaaaaaaatataaaaaattagccggatttggtggcatgcacctgtagtcccagctggtcgggaggctgaggtaggaggatcacttgagcctgggagttggaggctgcagtcagccaagatcacaccactgagctccaacctgagtgacagtgagaccctgtctcaaaaaaaaaa

SEQ ID NO: 14881 - DNA, 10956 bp, Homo sapiens
  misc_feature (5272)..(5272): n equals a,t,g, or c
acaagagagagcccagagcttacgtttgagaactatacgttcttcatccattagttatagtcaagagtctggagcagcaggtatttatgtctaattttttctaataaaatatttgacacaaaacactagttattttaactttttaaagttaagtattcctgttttcctttcacttgccgaaagtgtttttaagtgcatttctatcccagaagcactcattctttcctatggaagaaagtggttctgaaattagaaagattatactgtccaggaaaaaaggaagtgttgtgatgatttatataactgatagccaaagatagtctgaaactgttgattataaaggtatctgtccaggtatggtagctcactcctgtaatcccagtactttgggaggctgaggcgggccgaccacttaaggccaggagttcgagaacggcctgggctacgtggtgaaaccccatctctactaaaaataatttatattcctgccagcagtgtattgagataatcatgtactttatgctactagaaaaaaagtcacatgaaattttaacacagaatgttcgacatttaatacttttgtaacataaatgtttttttatacttgtttgctgattgatttgcttctctttcctaaagatttgtggaactcagtagtattagtgttaatttgtaggtatgggtccagaagcaattcagagaggacctgaatatacctaaactgttccctgaagagtcagcagtagccattgggtagttcacttggaaatgatattcctctcctccaagttgggggtgtgtatttattggtcacagaacacacagtcatacagagcaagagagaatgactctggaatcagactgcctgaattcaaatcccacattctctacttactccgtgagcaatcctgagcaagttacttgtctcatctttaaaataaagatactggccagtcacggtggctcatgcctgtaatcccagcactctgggagtctgaggcaggcgaatcacttgagatcaggggttcaagaccagcctgggcaacatggtgaaaccctgtctccactaaaaaaatacaaaaattagctgggcgtggtggcgggcgcctgtaatccccagctactcgggaggtgaggcaggagaatcacttgaacccaggaggcagaggttgcagtgagccgagattgtgccactgccctccagcctggatgacagagtgagactccatctcaaaaaataataatgatgataataataaaataaagatactaataatgcttatgtccatatagttgaaatagttcctggctcatagtaagtgcttttgctatatgaggtaggggaccttagagaaaccacagtcactttctagagatttaagtatgtctgggctatcattaaattaaaaaacgacagaaatggcttttattattttttaaaataaatcatgatttagttatccaaatgaatattggtcttcctcaacgtagtcaccatgggagtttttgtgtttatttcagcagtgcttccctggaatgcctcattggcataacttttaggatatgtcagcttagtatcagtttgatttctgagaatgactaaaagttgctttagagccaagtctagcagctagagtatcataccaggttggattattggtttggtatagatgcaaagtaagatgtgactatatgatcatgagtgatttttcttttatctaaaggagctttgagggtaattatgaaagaaaaccttaccaaatgcttttagccgaacaataacattgttggaataaatagtctcaaggcgattgttttaaaaaaaaacttcatttggaatttgttccatgtttgtttaaaaatcttggctgggcgcaatggctcacacctgtaatcccagcactttgggaggccaaggcaggaggatcgcttgagcccaggagttcgagaccagcctaggcaatgtggcgagactccttctctacaaaaaatttaaaaaattagccgggcgtggtgatgggcatctctggtcccagcaagccaggaggctgaggtgggaggatcgtttgagcctaggaagtcaaagctgcaatgaaatatgattgtgccactgcactccagcctgggtgacagagtgagaccctgtttccaaaaacaagaggaagaattagaaatgcagtgaggggccgggcgcagtggcttatgcctataattccagcactttgggaggccaaagcggccagattgcttgagctcagaagttctaaaacttcaacagcctgggcaacatggtgaaatcccgtctctactaaaaatacaaaaattagccaggcgtggtggtgtgcatctctagtggtgtgtgccagctacttgggagattgaagtggaggattgcttgaccccaggaggtggaggttgcagtgagctgccattgtgctactgcatgctagcctgagcgacagaacaagaccctattaatttaaaaaaaaaaaaaagtgtagtgaacttggcttctcgcagactcgtagaaagttaaaaaggaagctaccatctaaatggttttattattattccagatattttggtattgttttctgtatcatgatagtctaaaaaactagttttacttttaatattaattggtataataattagttgttttttttccccagtcactgaagatgtgtgcttagttacataaagtacattaatatttgtgtttataaaataatacaatatttatagtataatgtttatatatgtgtttaaattgtgacagcactgcatccacttgaggctcttttttatagctactaggaggtttaggcacttggagttaaattttaaatgaaccacatatttttcatttttgttaatgtagttttcccattttatgcaaataaaatatttaattggctctccactcctgcctctgtccccttaccgctaccaccctaagagattatcattgttaacatttgaggacatggtgttttgtaacctgttgttttttcttaatatgacaatggcccatattttagcagtaaacaaaaagatacagaagatgaaagcttagccaaacactgtaaatagaaatgggaagctttttcatatcggggaacggtggcttaattgattcttggggaatgggggatcaactaaccataaacaatttcatttaggatttttgcatcatgagggtatttggagagaaatatatcatcctataatgtgcacagtaagtttttcctaatttgttgctttgaggaaagacacaaagcaaactaaacagcctttcatagataaataagtatacagagagtgaaagatatgggtacaagtatatagagacctatcaaaaatacattgcttgtggtattaattctcatgtgtgattttagcatattaaaaggctgttttgtgtttttagaaccataagaataaatggggatgttacctttcagtttgttccaaagattgcatgcatcattaccaaagcttgagtctttttactcccctgtcttgttgagatacctactacttgagcatactctggaatgagaaagtttatcgattaacatgctgcttacgcagataggattagcatttccttaatttagtataccacgtgttgtatcaggcataaaagccagctttttttagtcataccccaatgtttaaaattgttaaatgcagacttcatgttcttttgatcatttaaatcatgacatggatatttttaatttttatattctagtaattatcaattgtcctggtctggctgcttagagtatcagtttgctcaaaattgcttgaatcattaaagcaaatactaattgtgagcattgaccagatcttaagttaaaaaaaaaaaaaaagcatctttggtcctagaagaagtgctaaggaaacctgaattaactgataaagcacaggtaaagtttgaccataaaacttgtagaaagaatggaatatagcttaatgcttataatgtaagacattggaacaaatacttaaattcagtggttagcactataaatatcttttcttaactgtgagtagttggaaaatatagctggctaatagtaattacaagttactatttaaacagatgccaacatgcaaagtagttgtataattttcctaaagttatgttacacttgattttaacttgacgccattgtgcattgtaaccatattattatacaaggagcatagaccaacaacagttgagtaaatgggtgaataaatgaataaaaaggataaacacaactaatttaaaagtcatgagcataactaacaatgattgcttttattctgaaactgttttccatggtttataacgttcatagccatatgacccttccttaatctcttccttccttccttgtattttgggtactgattctttgcaaggtccatctctcttttgtgtgaagtaaaatactgggaaaaggctgcttttctaaagatacctgttttgctatttttatagtgcttataactgatgtaattagaagaaataaattcatagtgctttggatatagcacctcagattaatatcaaattgtcacctcctgttagtgttcattcactaaaggaatagtgtacagaacgtgtacatttgaattaagggaagatggttagaaaagttctggaaccgggaactaccattcagaagacttctatgggaccaggacaaagacaaactttacgtagttcacaatttgcctagagctgtccttgattctcctttctctttttattctttttttattctttgttctcattgttttactactatgttttaaaaatgtttataacttgatattttaatgtaaagtatgttttcttagaagggaagaaaaaatgctttatatactaaaaacagcaggctgaagctataagttaacaaactacatcttaagattttttgacagtgctacaattggtaaactgctagaagttatttttagaccagttttatgtacttaatagatttctctgtgttcccaatagctgatgatataaagccatgtccacgatgtgctgcttatataataaagatgaatgatgggagctgcaatcacatgacatgtgctgtttgtggttgtgagttttgttggttgtgtatgaaagaaatctcagatttgcattatctaaggtaagcttatagaaggagctatttatatgtaaatgtaattttatattgtaagacaaaataacttgtcttaaatttgggttttataagatacttaaagggattggttntattctagttaaataatttaaaagaaaccaagttattatgctagtcatttggaattaataactagtcaaagtaggaaatggatatttcctttttttgtttttgttaaactagaatgctagtaagtatgtaataccctgtgtaattatgctagacccataaatactttcatttattttcccatacataaattttatcatttaggcacagagtgagtttatgatataatcagataattgatgcctaaaaatatgcatgttttgcattagtttactattaaaaaactgacttaagggtttgaggataatggaggactagggataaatttttaacctgaatctcagttatcagtatcttgttaatataatttacagtggttcttaccttatacttcattgaattttcccatacataaattttatcgtttaggctacagagtgagtttgtgatataatcagataattgatgcctaaaaatatgcatgttttgcattaatttactattaaactgacttaagggtatgagggtaatggaagactagggataaatttttaacctgaatttcagttatcagtatcttgttaatataatatagattaaataataaaatataatataaaataagatatatcaatatcttgttaatataatttatagtggttcttaccttagttttatgaactcagaatttaaaggggaaaaaagctcctaactatgaaaagtttttaaaaatagtcatggttttaatatattgcacaaattttgttattgtggtgttttgcagcagttatttacattataatttttccgttagtccatcaggatgtacttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaaggtaaaatgcatacttcttgttagtccattatcttattctaaatctttaggtgtattcttttagtattgatgatttttgggtttttttttttttttttttagacaaagggtatctttagtttcttcagtataaaacagttactcttttttcataaatttttagtgtttggcaagcatatataaatacgtataaagcagacttgctttaaaatgttctgaatctgaaaattttagtatgtttgtattataaaactttgagtataaaatattgaaggatacacacctgagatttttctcataggtatatccttgtaaggtcaggtctatgagatctttttaatgaaagttaatagctaaataacacatgccctcaggcaaagaataattagccagttcttgaattatttctgctgtagttcaaagctttttttttggattactgcttttaataaatacactattttgcaaattataacaatcttgtgaaagtccaaacaccagtgactaccactggcctctaattgatgaattatatttcattagctaagcaaatagttcttttgttaagggttaatgggataatttatgaggtcctaagaagtctgttgttgcctaaattaatagaatctctggattgagaagtaactttcagtagaatatagctaaaagaaaaaaaaaagaaattttctttggtatccaagaagatcaaaaaaattaaaactttttttaaaaaataaaaagaaattaatcccaaccttgtacccaagcagaacaaaggatagcaattttcaaaaagggaactaacaggccaggtgcggtgcctcacccctgtaatcttagcactttggaaggctgaggctggtggatcatctgaggtcaggagttcaagaccagcctggccaacatggtgaaaccccatctctactaaaaatacagaaaaaattagccaggcatggtggcaggtgcctgtaatcccagactcgggaggctgaagcaggagaatcacttgaacctgggaggtggaggttgcggtgagctgagattgcaccattgcactccatcctaggcaacaagagcaaaactccatctcaaaaaaaaaaaaaaaagaactaacaagctgggcatggtggcttactcctgtcatcgtagcactttgggaggctgaggcagaaggatcacttgaggctgggagttcaagaccagcctggacaacatagtgagaccccatctctcaaaaaaatttaaaaattatctgggtatggtagtatgcacctgtagtcccagctacttgggaggctgaggtgggaggattgcttgagatgggcaagtggaggctgcagtgagctgtgattgtgccacttcactccagcctgggtgatagagcaagatcctatctctaaaataaaaaaaggatctaaaggttgtcatactgtgtcataggtgttgtatgtacttttacttattttaaccctgcagcaacctcgatatttcggtctctgtgtgttaaaatattgagatttaggaaagtttatgtaatatatcttcagttacacacaaagaagcagagctgagatttgaactcagatgcatgaattcttaatataagttccatgattaagtttcagtagctatttgggaactcagtcatggggaaaccaccaactcatgaagcaatccattctgttgtaaaatggctactaattgttacaaaattgttacgtttgagtcagatctgtttccttttgtttcctttatttctgtttctaacttctgggacccgactgggaataaggttgatcttcttctgtaaaacagctgaattttttatattcaacatacattttataatcagaaaaataatatatactatttcttaaaaattagttttggggctgatgacaaacatatttatttgtcacatatttacttctgaaggttttaagtgagtaaacctggactttaaaaaatgttgggccatgtgtggtggctcatgcctgtaatcctaacacttggggagggtgaggagggaggattgcattaatccaggagtttgagaccagcctgggcaacacagtgtgacaccttgtctctacaaaaaactaaataatcagctgggagtggtggtgcatgcctgtagcccccgctattaaggaagctgggatgggaggattgattgagcccgtgaggttgaggctacagtgagctgtgatcgtgccactgcactctagtctgagcgacacagagagaccctatttccaaaaaagagagaaaaaataaaaaatttcaaattatattagctgatcgtaatttttcatgtagttattcaaagcaaggctttgctgaaaacaaaactattcagatacttagaagggaaagagagactgttgtaccacatgtacctataaatcatttatagagaagagattatttacctcattgttcaggtcatagggtacagttacagatctccttttttcaaacatgtacccaaagggttgtaaatgaatgaattagttttccattgaaataatattctgtggtgctttgggatcccaaccagcctaggaaaacctgctgagtcaataaagtacccaaaagctgagccttcacttaacaataaaaagtagagaatgtggcaaaaaatagtaaacagaaaaattaagttgaaccagaaatagtgggataatgtgatcactaatcaaacattggtgcttgaggctgaaaaattttctagaagactcctttctcttggcagcctgcctttgcaagtctgctccatcagttgtgccttttctcttcttcagtgctaagtttcccaggaatgggagtggggaggagcaggaattagctgcagtgctgaaggataatgaaaggtaccttgggaaggtctaccatctctgcctgcatggactgtgtagggaagtgaggaggctcattgacaaggaacctctagtcaatgctgggaaatgggattctgactaggaaatagaaaggtttcttgtcccatacatgcatcacccacctcccaccccaacctttctactgttttccacaacactcatcgtactttacagccttccaaaggccaaaggtgttgttataccatgtaataatagattattttataagtcccatctgtagtattgtttataagtcattttattttagagagtccccatacttttgaggctgttttgaatttgttttggaacagagggggaaaatgtgccatattagcccttgcaaaccatgaaaataaagatctcaaagttcatataatttcacaagccagtttttaatcaccgcttctatgatgatatcaaattctacttattaacacctgtcctgtacagagattgctgagtgaattcagtcctgtcttctggtagccattatttatcatcttttttctttctctgccatttactttgagctataaatgagagccctggaatttgagtcatttgtcaatattgtcttcataaaaaggatctgagaaaaaaataatactgtttattcatacttgtttattagaactgctttttaaggtcaatttttaaaaagaaaccttccctagaagccaatttttaccatttagagaatattctttagaaagaaacctttagaatgctggaagtatcctgttggtgaaccatgtaactcataactgtgttgaaaataataatcttaatttcttcctctttgctcgatacataattacactacttttgattaagattataaagatgacttttactcagaacttttaagcacaaagtaaaatccattaaatcactgtcttaagcaaattaataaggagcaaattatttgtgagaatatataatagtttaaggacactagtaggtttaccttgaactaagatactcagctacgaacttctatgaaaaatcactttagcaagtatagatctttttcaactaagttaaattgtaatgtattttctctttaatcccccacccctatttttattaattcaagattcacaatcgctatgaaggcaaggatgtttcaaagcacaaacggaatttggccatagcaggtggtgtaacgttgtctgtaatcgtgtctccagtagtagctgcagtgactgtaggtaagaaaatgctgaaaagtactaattacctacaattttatggagttaaagttttgtggaaggattttttttaattgttttttaatttgaggacaatttaaattgagcctgcagtaagtcttggttgaaagtattacagattcaagagcctagccttaaagtagttggtaaattgttagtggctgatacccttcctccccactccaccccaagtacagttcagaggcctggcacttcaaaagaaaaaagtttgcatctctctctttttccccttatgtgcattacctgaaaggctgggaaccttgaatttgcttaacaactgggtaaatctacttttggcaaatgttccagccaactcttcagaaccctggcgcttttctctgtatgactctcttgaaaagactttctaaaactcatgtttctgtgagttattttgttgttgttgtttgtaatgactgatttaatttctctttaggtatcggtgttcctattatgttagcttatgtctatggcgtagttccaatttctctttgtcgaagcggaggttgtggagtctcagcaggcaatggaaaaggagttaggattgaatttgatgat

SEQ ID NO: 14882 - DNA, 760 bp, Homo sapiens
ggaaagtttatgtaatatatcttcagttacacacaaagaagcagagctgagatttgaactcagatgcatgaattcttaatataagttccatgattaagtttcagtagctatttgggaactcagtcatggggaaaccaccaactcatgaagcaatccattctgttgtaaaatggctactaattgttacaaaattgttacgtttgagtcagatctgtttccttttgtttcctttatttctgtttctaacttctgggacccgactgggaataaggttgatcttcttctgtaaaacagctgaattttttatattcaacatacattttataatcagaaaaataatatatactatttcttaaaaattagttttggggctgatgacaaacatatttataagtcacatatttatttctgaaggttttaagtgagtaaacctggactttaaaaaatgttgggccatgtgtggtggctcatgcctgtaatcctaacacttggggagggtgaggagggaggattgcattaatccaggagtttgagaccagcctgggcaacacagtgtgacaccttgtctctacaaaaaactaaataatcagctgggagtggtggtgcatgcctgtaccccccgctattaaggaagctgggatgggaggattgattgagcccgtgaggttgaggctacagtgagctgtgatcgtgccactgcactctagtctgagcgacacagagagaccctatttccaaaaaagagagaaaaaataaaaaa

SEQ ID NO: 14883 - DNA, 422 bp, Homo sapiens
cttaaattttattgacagctctgaaaactcccctaaatttccaggcaaaaggaaatgtttagtatttacaaaagacatgcattgataaaacttgattgttgctgctttcaaagcaaactagaaacttctagaaatttttaaattgaaagttttatagaggtaatggtagattcacatgcagttgtaagaaataattcagagatcgtatgtacctttctcactgtttgtctcggtggtgccattttgcacaagttatagaacaatatcagaaccaggatattggcatagacacaatctaccaatctcactcaaatttcctgatttacttctagttatttctgcacagtgtatttagttatatgtattttatcatgtttaagtttgtgtatccaccaccacagtcaagatactgaacagttcca

SEQ ID NO: 14884 - DNA, 422 bp, Homo sapiens; identical to SEQ ID NO: 14883

SEQ ID NO: 14885 - DNA, 189 bp, Homo sapiens
acatgatgaaaccccatctctactaaaaatacagaaaaaattagccaggcatggtggcaggtgcctgtaatcccagactcgggaggctgaagcaggagaatcacttgaacctgggaggtggaggttgcggtgagctgaaattgcaccattgcactccatcctaggcaacaagagcaaaactccatctca

SEQ ID NO: 14886 - DNA, 6784 bp, Homo sapiens
ttaatcccccacccctatttttattaattcaagattcacaatcgctatgaaggcaaggatgtttcaaagcacaaacggaatttggccatagcaggtggtgtaacgttgtctgtaatcgtgtctccagtagtagctgcagtgactgtaggtaagaaaatgctgaaaagtactaattacctacaattttatggagttaaagttttgtggaaggattttttttaattgttttttaatttgaggacaatttaaattgagcctgcagtaagtcttggttgaaagtattacagattcaagagcctagccttaaagtagttggtaaattgttagtggctgatacccttcctccccactccaccccaagtacagttcggaggcctggcacttcaaaagaaaaaagtttgcatctctctctttttccccttatgtgcattacctgaaaggctgggaaccttgaatttgcttaacaactgggtaaatctacttttggcaaatgttccagccaactcttcagaaccctggcgcttttctctgtatgactctcttgaaaagactttctaaaactcatgtttctgtgagttattttgttgttgttgtttgtaatgactgatttaatttctctttaggtatcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgtaggtaagtcctttaagcaaaggaagaaaatgtgcttattaacagtgtaagtagtggggaggccagagataacatgcaactcagaatttccattgccatccttttactaggcctaatagtattcattcagaagtacataagtgaataaactgccaaggaggagtgtatggatgaaagaggtgggggtaattctgggtatctgacctctaattggaatataatgtcttagaaatcataaacttttcatcttaaattttgcctgaaacattataaataactaagtaaaggatatgaagaggaatacagttaataaaagaaatacggatgaccaataatacaaaaatatcttcaactcaatgttattcaaagaaatgtgaattagaacagtaacgagcaaagattaagaagaataaaaaagccttcatagactgcctataggagtatgtcaataaaccttttttaaaaagtgcatgttctatattctagcaattcttgttttagaaatttgtcatagggaaataattaggcagatgtgtaaagataatgcctactttcttacctcttattttctcttgaactggcctcaatcagatttttgtccctaccactccagaattttatttctgctattcactgaagcagagtcaccagtggcctccacgtaacctaatacagtggtcaggtcttggtcctcatcttaacagtatatccgacatggtagagactctacccttcttgaaatacttcacttttcttatgggaaaccacttcttaccatatttcctggccagtccgtctcattaatctttgctggttcattttcctcttctgacctctaaatgtttgttccccagagctcagttctcagaattcttatgtatctacacttttcccctaatctcatctattaaataatgcatagaccgacctctcccctgaacttcaaacttgcatgtgtaactttcctctttaatctgcacttgagtgtctaacaagaatttcaagcttaacttgtctacagccaaattcttggctctaaaatctcttcttcccttcatcctccttaactcaataagtagcttctccattcctcctgttgcttgggccaaaaaccttcacttaacaatgcctccctcttttccctcttgtcctacatctgattgatctgtcagcaaattctgctgcttccttcaatatttagccataatccagccacttcttactctcttcgttgtccttcccttagtccaagctaccatcctctttcctgggctattgtaatagcctcttaactgctgtatcaacttctcagcttctattcactagtccatagtgcagccatagtcacatgtctaaaccctgtcagattataactttcttatgctcaaaacttccccagtggcttctaactgtactggggaagaaaatccaaagtccttatcatagcccaaaaggccccacatgatctgccccaactatgtctctgagctcatctcttgtcaccctcttattttataccactcttgcttgatttttgagggtgccaagcattatcctacttctaagcttttaaactggcagttctctgtctggaatactctttccctagaaaatttcatgactcactgttttacttcatttgtctctacaagtattaccttatcaaagaggccttctgtcatcacatcatataaaatggctcacagacatgtacgtacatgcacttttcatcactctcctcccctttactctcttgtatttttcctcatagcatttgtcaccgtgtgattgggtatataataggaactcaaatattggtgcaaataagtgactccttaatacaaaatgtgtgagaggtactgtaaaattggaacatagtgttatcagatcttaataatagcttgtagacagaactgtggcatatatctagaaatcaacttttagcctattcttactgacctagagaataataagctctttaaatgacacccttaatgaaaactgtcacataattttcctctaaagtcagcgatattttttaacaatcatattctttatagaattcctaaatctgggtttttgaaaaaagaaactagtgaccatttaaaattgttggctctattcccactgcttctagtggactagcctgaaaaaaatatttttccatgtctgcgtatattttataccttatataatgtcctctctgaaatcatggaggaatttaagaaggagaaaattgataatcatacttacttagtttctttggaatatttgcatttagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggtgtgtgttttggtttggtttggttctgctttctggtaactacaaattattaattaggtgagaattttgaacataaagcatgatgattatatataaccctactatgtcaaggttcaaaatagtaatgttaaaaatgaaatttggggccaggtgcagtggctcacgcctgtaatcccagcatgttgggaagccaaagcaggtggattgcctgagctcaggagttcgagaccagcctgggcaacatggcgaaaccccatctctactaaaaaaatataaaaaattagccggatttggtggcatgcacctgtagtcccagctggtcgggaggctgaggtaggaggatcacttgagcctgggagttggaggctgcagtcagccaagatcacaccactgagctccaacctgagtgacagtgagaccctgtctcaaaaaaaaaaagaaaaatttggtggtagatttctaagtctaaggaataacattctgccaattttttcactgtccttgtcacattttatattataaatcgttgctacagctgcttcagtagacattgaagcaaaggcagtacttaagcctagatcttacctctgtgggtaacaacagccagatattaggagatgggactttggctgagtcctgggaaacaggtggagtcaggacatccaggaatgtgtgaactgggaccgggataatcggctagggtccttttatgtattaatgcttgcttactttgttctcaccaagtcttttatcaatagccatatagataagtaggaaaaattatcttcccctgtttctctttaattcactatttttcacttaggcttattagccttgctttttttaagtgtaggggagaatacatgaattaaaagataaattagacatcttatttttaggtagtttgccttttaaatacaaactcttaagttatagtggtatatactacctctttttaaaaaggcaaatgttggttgggctcagtggctcatacctataatcccagcactttgggaggccaggttgggaggatagcttgaggccaggaatttgagaccagcctgggcaacataacgagaccctgtctctaaaaatatatataaataaataaagtattaaaaggcaggtgttatttatagagtcattttttaatatagatgcccaggatttttggattcattggtgtgtcatgtttaatgattaataatgtattctaactttgtgttttgcattgaaacattacaaagtgccatatgctgagtgagaataatggagtacatttaagtgaaaatcctttgtgtcttttttgtgttatttcattaccactttacttggcagacagctgatgttccccattttatttggatggctggtactatgcagtgtgctgcagtagaatttaaattaaataaaaggaaataaaaaataatggttcctaaaatagcttctggttactagggttcttaactgaattatttaaagatacatattacagtagtgctgatattaaatataattttggtgatttcatacccccctttaaggttggaagtacaagcagatgtacagaaagaacggtacagtctaagtggagaatctggcacagtcagcttgggaacagttagtgataatgccagcaccaaagcaatggcaggatccattctgaattcctacatcccattggacaagtaaggaaaaaactgttaaaaaattgaaagtattttttaaattaaaggaataattcctatcattagacaaattaccagtgaaaagtggctaccaactattaagttctctgagaaaaggaaacagtgagctgtccagagtaggcaaatctgtatagatcataaagtggatttgtggttgtcaagggctgggaaagggaagaatggtaactaactgctaatggatgcaagatccctttttgggatcatgaaaatgttctgaaattaggtagtggtgatggttgcacagctctgatcacaactaaaaatcactgaattgtacactttaaacaggggaattgtatctgaataaagctgttctttaaaaaaaggtagcatagtgtctagaacagcataagcaataaatgtgtccaccactattttaaaacattgaagcattataaagagttctgttatatcaagtatgttttttaagtagaacgtgttctgcgttaaggtgttctcatagcttatatatagtctgaattttccacatagaaacccttcccccagtcatctgaacaaaaagaagtcagcaattatgtttgtatttgttactcttatatttcagagaaggcaacagtatggaggtgcaagtagatattgagtcaaagccatccaaattcaggcacaacagtggaagcagtagtgtggatgatggcagtgccacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtctggaaaattccccacatcagtgtagcatttctgtggttacccaaactgcttcctgttcagaagtttcacagttgaatcatattgctgaagaacatggtaacaatggaataaaacctaatgttgatttatattttggcgatgcactaaaagaaacaaataacaaccactcacatcagacaatggaattaaaagttgcaattcagactgaaatttaggcccataaatgctgcagaataattaccactgtacaaccgtgtttggagctggttgaactacatgtgactacttaagtttcaggttaccagcaaaagccgggtttcattatcataatgcagatacattttctgtgttcagcaaggcattgtgtgtcatgtggatcttagttaccaaactatgaagtgaaggctttaaaagtgcattattttaaggataataaatttgaagagcaaagcatgttttgtgtgtttgccacaaaacattgcttgaagcacatacttagatagaaattggtcttaatttatataatcaatataaaatactaatgcaattctacagcattcaaatgaagaaaacttgaggctttagggataagtggttagtgatattttattgaaaccactaaagagataagtttaaaagaactgcataggttactctcagtatatgatactctgtaacatttctatttatatcggcataaatttcattttttttcttcatatgcaatgtggttgta

SEQ ID NO: 14887 - DNA, 10008 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcggggtgagctgacggagttagaacgggcgacggcaggggcgggctcggggtcggggagaggccgggctcggggtcggggagaggccgggctcggggtcgcggagagggcgggctggggcggcggcggggagccgggcttgggcgagggaggtggctccgcttacctcagcttttccattcgccaccgttcggcccccacacgccacacccacaagtcggcgaagcccaggagaccaccgaggagtttaatcgagagatgttctggagaagactcagtgagtgcgcctccttccgggctccccttgcctcacttcctccagcgtcccgaccccttttcctcccgctgtcccccacggaggggactgctctcccccgctgcatcctttctgtgaggtaccttacccacctcagcacctgagagggtgaaatagaattctaacctcgacattcgggaagtgtttttgagaagtctcggtcggtaagggaagtcttccaagtccgtgcagcactaacgtattggcacctgcctcctcttcggccaccccccagatgaggcagctgtgactgtgtcaagggaagccacgactctgaccatagtcttctctcagcttccactgccgtctccacaggtgggcttcactttcgtggaatccttgggctgccgagttacaccttaggaatcctctaattttctttccaccttttgcatgcacgccaggagatttcttttcttcatctgtccagtgaggttaccgtttttacttcacaggattgttgtgaagaccgaattgccaagtgcagttcctggcgcggagtaggcaggtcttataaatattggttcagtctgaagtttatcctggttgtttcccttctgataattttttaagcactttttatttgctgggtgttttcacatacttgatggccatctgacagatgagcaaggaggctcagaagctcagcttaagatttaaaaaaaagcaggggggctagagtttaaatcaaggtctatctgatgtctaagctacctattctgttatactgcataataccctttttatattattttttatatttaatcagtaacatatgtagatagtacaaaattcaacagatatcaaagtgtgttaagtttacctttccacccactttctcatttttgtctcccccagttccttttgcattattccacgtatattctgtgcatatatacattcatatacatttatctgtatgtgtcagcttctttttacacaaatgatacataaacactgttctggaccttccaacttagaattactgcaaacagtgtcgtgatgaattacctaattctgtgtatgtgtgtatattggtagaaaaaattcccggaagtagaattgctagaacaaagatttatgcattttaaatattcctttattataaaactaatgaaagtaaacatgttggctatgaccacgtatgctctatgctcagtttttctagagttgtgtatgcttaatataggagtaagattcttttaaaatggcatattcattgccttatttgattttcatagtcaattgttttaatttttcagtctacatatataggtgtttggaaaggatataaatatcttctgctgcatgtacctacagtgataaactctctcctcctacatacctttgagattttttttttttttttgagacagagtctctctctgtcactcaggctggagtgcagtggcacagtctgggctcactgcatcctctgcctaccgggttcaagcagttctcctgcctcagcctctcgagtagctgggattacaggcacctgtcaccacgcctggctaatttttgtatttttagttgagacggggtttcaccatgttgggcaggctagtctcgaactcctgacctcaagtgatccgcctgccttggcctcccacagtgttgggattacaggtgtgagccaccgtgcctggcctacctttgagatttgtgatgaggaaacaagagatgaattgtatgagagcacttcaaaagattcatggaaaatacttatttcaaaaagagtagttaatattaccttatttttcttatctgctaacccctttctttcaaatgcacttaggacttgctgctaaaactcactgcaagtaagataccacaaggaggcagcatagaactgattttctatacatgctcaggacagtagtttcactcatagatgaaaagttagaatttggatttatttgaaatatatacaaatattcaagtatatacatatattcaaataaatacatatatgtatatatgtgtgtatatacacacatacatacacatgaatcatcattgccttcttgagatctcaccactttagtcctactaaaagatgggtggttgttggtttttttttgttgttgttgttgttttttaaattccaatctgtatggaatgatactttaataaaattatgtgctcggatgttgaataaatgtcaaattgccataaaagtttctaaacactctcagtcactgcttatctcatccctgactggtcacaaacagtttgtagactggctccaacctggaccacatttgtatagtattgacttagaatttaacagaaaattgaggacaaggaagatgagaaagccagtgaccacctagaaggaaaatagttaacatggagcattgtcgagtccatgctagttacctttagttacatattctgattctgttaaaaaaagagagagacctggttaatggtttaataaccatggtctgtcagttggtctgtctgtctctctccctccctctcttttctgtaaagggccagttagtaaatattttagattttgtaaccaactacccaactctgcccttatagagcaaacacaactacagacattaaaaccagtgagtatggctgtgtcccaatacacttcatttccaaaaacaggcagtggggcctgacttggcctgaggaccacagtttgccagctcctggtctaagatatcatgaatatcttgggatacagagtatcaggaataagttttttcctgctgtttcttaatggtttattgagttgtcagcccaatatctactatatagctaactcctccctggtatgtgatgagtatagtaggcctgccttcataccaggacttcagaaaatgtttgatgatgctgtagaaatatctgccctaggccgggtgcagtggcttacacctgtaatctcagcactttgggaggccaagggaggtggatcacctgaggtcaggagttcgagaccagtgtggccagtgtggcaaaaccccatctctactaaaaatacaaaaaattagctgggtgtggtggcgggtgcctgtaatcccagctacttgggaggctgaggcaggagaactgcttgaacctgggaggtggaggttgcagtgagccaagattgcgccattgcactccagcctgggtgacagagtgagactctgtctcaaaaaaaaaaaaaaaaaaaaaaaaaagaaagaaaaagaaagaaaagaaaaagaaaagaaatatctgctctattccacagcagaagggttgaccactttgatctaatctgtttcctttttcataggaaacccagaagttctgtgaacaagtccatgctgccatcaaggcatttattgcagtgtactatttgcttccaaaggatcagggtaagccacataagtgttgcatttatcgtgtagatctttgctaatattgtggattatgtcttgtgacttttacctttacccaacttgaacatgtaactttctcccataaaatacagtgaaggataattttgtaatgtaagtgacttatataaacaagccattattctaagatacagatgctttgttcctatgacttcccatctcccctgccttgcctgactcataaggcttttaattctcacagccttctccctcttcaacccgttttaacaccacagatactggctggctctcagccccatatgcaggctcaggccatccttactttcctccacccatgttatatctcaccctatttctgaacatctgcataggttaaatggcctccagccctgcctgtagaatcatgcattgattataatcatgccaaaattataactgaatacatgtcatggatcttcagggttactcaagtggcttaaacttcaagtgtttcatctacagttgttaagagatcacggtccttaatgaatgaatacatggtgtcacggaaagattttgttccaaatctcttttgaagaaaacactaaggaatggcaggaggggcaagaaaatgccatggggatataagtaagacctgagttttgtgttagcatgtaggttaaagcatgtgggtgtacattaccttatagttctgtaatgcttagactcaggaaagcagatggtgcttctgaaaagaacaccaggttgcttattctttgggtttggccacagggatcaccctgagaaagctggtacggggcgccaccctggacatcgtggatggcatggctcagctcatggaagtactttccgtcactccaactcagaggtagtgatgccacagtttaggttaccagttattggggttccttgcctcagaggggaaaagctcattttaacagcaaagttactgacagctgagagtaatgaccagcaggaagaagctttttaggagacaggaacctaggttattaatatatccttactgatttctttccccagccctgagaacaatgaccttatttcctacaacagtgtctgggttgcgtgccagcagatgcctcagataccaagaggtgagtgaaagtgggcagtgggccatgtctgctggccaaagcaaagagacctcatgtctagcttccagctttgtaacatgtatttgaatttatataaacagtctagtgaaatatatatattttattaatgaaattaataggtaggtattaatactttttgtcattctctagttatcatacttctaaattccactcccccttgctgtggctgtctcttgttgaacaagtatggtttgttttcctagtcctaccccaagagtagtattatggagcacactgaagcagttatgaggtagagacagctaggccaaaacagtggttgtccaagaggaccatgatgataaacatcatgtgaccattttatttcttcttgtgaataaaatacaagctttttaaacccctatctagataccaggggatgtagtgagaattttttattaaacccgcacccttgtcaaccgtccttggcactcccatcaataggaacaatgtgattgttccttgcagtcataagaaaattgttggatttctcctctaattctagtgcttctgatttttcactcatagataacaaagctgcagctcttttgatgctgaccaagaatgtggattttgtgaaggatgcacatgaagaaatggagcaggtgaggggacctccatcattggaaggcaactccttgactagtagatgagaattaattataaagagagatttcctgagcattgaccagataggtcccattctcactactgtcctctgtcttccatctcccactgcttgttagtgtttgatttagtaccactcctctgtgttcccttactggacaaggagagcgagaacagggtttatgaagtgattcaactctgtagcccttagtgaagtggctggctaagatttttggacaactaagacatcgtggtaaaagtataataataggcctcgccttttttttttttttttttttttgcattcacatacatcatggtatgtcttaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctaggtaagcgggatccccacttgaaacatctgagcagcagcgttctgatttcaatttgtgttgtcacctcaaggttttcacagtttttttatattttgaaatttttcaaacctataggaaagtttaaaaagtaccttcagtgaacacccctatatccttctattagatttgcctgttgttcacattttttcctatattggtttatttctcaagagatactgtttcatatttattccagaatgttttgagagtaaattgcagacagcaatgacatttcacccctaaatacttcagtatgtatctcctgaagtactcttattcctactcttattatcacatccaagaaatttgacattgaatataatagtattatctaatattcagatttccccagttgtctgtatctaaaatgtcatataaattcagggttctgtcaaggtcccacattgcatttaattgtcatctctttagtctcttgaaatctagaacagttcctatcctttgtagtcttttttaatcaacattttaaaaagaaaccaggacagttgtcttgtaaaatatccaacaacctggattcacgtgattgttagttctcatttttgcaagaatatcatataattaagtgttttgtacatctcattttatcatattagggaggcacatgatgttggtttgcctcattattggtggtactaaatttgatcacttaaagtggtgctcactttagtaaaggtatattttactctaattttagcttccactgatgaaggctgcctgcctatattagttattaaactgatggtttcacatcctcacatttttgactgaattgatcatgcaccctactatgaaccaagggaatttcccccccagcttcctagtgaaatggggtatggttgtttcaataaagactggttgaactcattctgtattggttgcccagttgcccaattttaaaaactgacaggcatttctgggacagtttctcactgttgacatccatagttgtgtactagaaacaacctggctgcgtttttttgttaatgattacttttgttttctgctcttagtgtggatgatttggctctgagcatatatccacctatgtgtcacctgaccgtgcgaatcaatgtaagtactggctttgagggaatagctacagaacaaatgggcagaatttcactaatcactagtatttcctgtaagctatagggtacatatttattagtcacatttggatggaagtacaacagtaatgtcacagttcttgcatgcgtttggggttgataaatattcactgaagttgaattataatagccatgagctttggtagttctctcttccataatcacctgggtaatcattcagaaaagcccaaaggccttagaaaatgatgctttaaggctgggcgcggtagctcacacctgtaatcccagcactccaggaggcggaggtcaggagttgagaccagcctggccaacatggcgaaaccttgtctctactaagaatacaaaaattagccgggcatcatgcacctataatcccagctacttggaaggcttaagcaggagaatcgcttgaagccgggaagtggaggttgcagtgagccgacatcgcgccactgcactccagcctgagcaacagagcaagactctgtctcaaaaaaaaaaaaaaaaaaaaaaaaaaaaaaaaagcttctttgaaaagaaagtcttaattacacggtaatttaggaacttctcaacttgaagtcacaagtttctaatttctagactaggcagcaattagattgaacttcagctgttcatgaagtagctggctgaggtcacatgtttctgatttctagacaaggcagaaataagtgttccagaaacatactctgttctaatacaaacacattgtgtgatttaactatggagagtcaactttcttataaaaatctgattttattgtattctttgaggttctgtgccctttactagagagagttctgttctctctaatgttattggaaagagcagtaaaactgccaaatggcttatattttacaattgaatgtatcaattctagtaatatttgataaattggataatggaaattagattcatcagatgtgtcttcatgatgtataaacaccttgaagtagaataggatccttttgggcattaacatttttttggcattaacttttaaaaaattgacttcctaagaaataaacatttttagcaatatgcctagtcagctatcccaaacatagtatctgctctagcaattttaaaatgtgtactgcatatgcatcttatatgtattgatattttatattaaacgtctccatcttatccttatattggtgttcttaaaattcttaatgcgctttttttttttttttttttttttttttttttaaaggaaccttagtcatttctgctttatattttgagctatcagcatttgggaccaattcaggttacattttcctttttctgtccttttttaaattgaaaatattttagatctaaaaaatcttattaaaatgttatagcaatagtattaataagatcttgctaaatagaaaagaacccgtaatcctgccaccctaacctaatcagcattttaaattttgcatacttccttcaggtcctttttctaaataatttttttattacttgggtctttaaaaatatttgaactcacctttttatggtagggctcagggtgaataacttctgtgtttcttttctagtctgcgaaacttgtatctgttttaaagaaggcacttgaaattacaaagtaagtatgaagacttctcagatagctttttgtgagtaaaacggaactgctgtccagacgttctcaactccctagctcccatttcaaggagtgggaaagggtgggtgtgggattttctttcagcttcagttgtggggcagctgagattctgcaaagaagcttccctttaaaaaaattttagttttccctgtgctccctcctgaggataggttttcccttgacatcctaataagtttaacttacttctttcctattctattcacagagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgattaaatgagtg

SEQ ID NO: 14888 - DNA, 10008 bp, Homo sapiens; identical to SEQ ID NO: 14887

SEQ ID NO: 14889 - DNA, 4636 bp, Homo sapiens
caagacaaaatgacaataataataataataatacctagaaactcacacactgagaatggggcagtaaataataatagggaggatagaaaagtcagcatggcattccagatgagaaaactgaagcaagttaaactttctacatggtaaccgtgattatgtagttgatatacaaagtaatgactgtgggccttcaagaagaggttaaaatacattcattatattaacgagtgcatcttagaaagatttctttcaaaaagtagttgaagtttttttgctttaaggagtaaatctcaatcatctggaaatttaacttctgtggaatacctctttacatcttaaaggaaatgttaatgcattatattgaggttattattgcaatggaattttcaaaaatgtgagtgtgctttttttgtttctagaatctataagacacatatctgttctaggtatagtgtctactaagacaatttcacaatccaaaaaatagttggttagcaaggatatcaagtacaacacagagactagcaaagagggaaggctatgaaataaaatgcttatagatggctagtctcatatctctgctttattcctataaatgtatctcatgatatatgtaatcagaattatagttatttaatctcctccttttttgtccattgcctcttttaggtccatggttttttggtgaaatcattgatggcaaatttggttgctgcttttcctttgggatatttgttaatggacatttcctacaaggcagcataacatttataattggaattctccaggtaagaagtcagaaaagcaatttaagaacatcttggacttgtcagactaattgcataacagttatgaattaaatccaaaatccagaattaagtaccatagatcatctttcctactttacttgcagggcagtctttaataaaagcttcatttgcttttaaagtgcttcctaaactccttccaccactctcatgtaaacatctaaaatacatttttttttccccaagacagtgttctgctgtcgcccaggctgaagcacagtggtgcaatcttggctcactgcagcctccacctcttgggttccagcgattttcctgcctcagcctcctgggtagctgggattacaggcatgtgccaccatgcctggctaatttttgcacttttagtagagacagggtttcaccatgttgggcaggctggtctcgaactcctgacctcagatgattcacctgccttggcctccgaaagtgctaggattataggcgtgagccaccatgcctagcctaaaatacatttttgtcatgaagtgtttataagaggtgaaagaagtttttgttgtttttgtttcactgtgctttttcattgacaaaaaaatgaaacaagggattatggtagaaaaagttttagatttctgagtaaaccaaaactgattatgatgatgaagaaggaaaatattttagagggaggaaactaaaaaatagacacattaaaaaaatgggtcagttattcagtggaaactgcattattcaaaaaccagacctgggctttcctagcaatgtacttgtttaggaaacaaactgatgtattaggtttacatttgattcctttaaaataaacacacaaagaaccttgatccatagaaaaactacataaacagatttgaaaagtatttatctaacagtttctttattttactcacctaatggagttagtggaccaaaatttgaagttttggaagagatccaaaaacattcaaaataagttcatggccttctaacagggcagtagaacatgatccaacaggattagagacagccaagtaggaaagacttctgcctagcaaacactgacccaagtccagaatattctctgcatagcagcattatatacatgagtaggtcctgggttcatttcagttttcttttcttttcttttctttctttttttttttttgagatggagtctcgatcttgtcgtccaggctggagtgcaatggcatcgtctcggctcactgcaacctctgcctccctaattcaagtgattctcctgcctcagcctcccatgtagctggggttacaggtgcctgccaccatgcccggctaatttttgtatttttagtagagacagggtttcactgtgttggccaggatggtctcgaactcctgacctcaggtgatccgcccgtctcggcctcccaaagtgctgggattacaggcgtgagccactgcacccagcctcattgcagttttctattatgttgatggaggctgtctctaaggagctctctcataccaaatgaatcctgagccttaccaaaaggcagggttttttcctttgtaaatgtttacattcatattctaataaatagtacactaataatggattttatgtatcatccagacccatgaatcccaaatctatatctctgatctagacctcttctctgcacttcaagtgcctctatatccaatggccacagatgtctaacaggcatctcaacttcatgtgatgtctctctgataggaacattatttccaccccaaacctgttcctctctgtttttccagttttaataaatgactccaccattcacctgatttctccaagatgtatcctcaattattccctttccttcataccctgtatctatttcaccagcaagctctaccttatttgatctgcttccaatgcatatcttgaatccatccacttctctccatttctgttttcctaatctaagttgtaattatttcttgcctgggtcttctccctgatattcttgcctccttactctcagcttaatacagagcatccagtgtgctcttttaaaaactttacaatcagctcacttacttttcagcttgaaatgctttgaagcagagcagtgatctgggtcctgccgactgccccaatttccacctggctcatgctctgcatgcacttccttaaagaggccaagacctctcccacctctgggcttttcatttgttccttctgcctagaatgcacttccctccgctgattcattcttgtccttctggcctctgagagcctttctcccagttaccttctcatgacccagttctttccttcattgaactaatcacgatctgtaattatattttttggtttttttttttgtctgtcttctccctgttagaatgtaagctctatgacggaccttttctaacttgtttgccattgtgtccccaacttggagcctagctcatgcctgctacataatgggtgctcaataaatatttgttaaatgaatgaatcatacagcagctcaacttggattataatttagatactctaatttatattccagtacttatcatgctacctcaaacaaaaatggaggtaagaaaaaaaatactgatagccaagtcctcccctcactccaccaaaaaagaggggttgttgtatgtgtgtgtatacatttactcagttcaattccagcttaacaccattgggtattaactgtgtatatgatactgtactacaagttgggacttcagcataaattaaatgatacctgcctctaagatgaataaaaggacatgggcaaatacacaactagccacaagtcagctgttgtgttataagcaactgtgcttgaagtaaattagctaacgccaagacagatagcagcatagtcttaggatccactaataatgcattattaagaccaaactcttccaaggacttgggagtaagctatggttctgttcttttccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatgaataagaaagac

SEQ ID NO: 14890 - DNA, 567 bp, Homo sapiens
tccttttgtaggtgtaattcataacatatgcctttctgctgtctttaggtataatcagcaacagcagtcattctttgagtgactaatgtatacttggggttggggttgaaattccttaagccaaatgagttttagcttactgttttgaagtgccattttgtattgttaacaagtgtcatgaagggaaggaactaaaatcaaactgacagagtgtcaaggcaacaaaataacataaacaaaataataacattgtacaacagtctagttcttttatcctttcatatagagcctattttttatatacttttatatttctctactggaccaaattcatgttattaacatcagactttaattgtgggatacttaatgaatatagaactctaatataaagacttacctctagctgaattattctctcaggtcctgtattgtataacttcgttcagtcatgtttggatctttaaggataatgatcagggaaagcactgatcaatgtaattttttttttttttttttttttttgagatggagtcttgctctgtcccccaagctggagtgcagtgg

SEQ ID NO: 14891 - DNA, 4636 bp, Homo sapiens; identical to SEQ ID NO: 14889

SEQ ID NO: 14892 - DNA, 567 bp, Homo sapiens; identical to SEQ ID NO: 14890

SEQ ID NO: 14893 - DNA, 7784 bp, Homo sapiens
accacaagtcctgaagagaaaagaaaaatcattggggatacttttgttaaggtacctttgtttttaatatcctcaacatgtactatttttgatgtgaatcttagtatttgtttttccttgtcactatatcaaataaccaaattagctaattttaatcctttttcttatgtggctgagagttttattgtatattgtcattatattgaccagtagaaactgttttatgtttttttgttgttgtttggttttttttttgtttttttgagacagagtcttgctgtgtcaccaggctgggctggagtgcagttgcacgatctcggctcgctgcaacctctgccttctgggttcaagtgattctcctgcctcagcctcctaagtagctgggactacaggggtgcaccatcatgcccagctaatttttgtacttttagtagagacgggggtttcaccatgttggccaggttggtccggatctcctgacctcatgatccgcccgcctcagcctcccgaacttctgggattacaggtgtgagccactatgcccagccaactgttttatgttttaataaacatgtttgcctacattgccaggctattattttaagaatagatgtctttaagagtagatgtattcagcttatcatagactttaattcattgattatctcaatggctaatttcaagctcttgaatggaatgttcacatacctttgtttttgtttttttttttttttggaggcggagttttgttcttgtcactcaggctggagtacaatggagcgatcttggctcacggcaactttcacctgctgggttcaagcgattctcctgcctcagcctcccgagtagctgggattacaggcatgcaccaccatgcccagctaatttttttctttttttgagatggagtctcactctgccgcccaggctggagtgtagtggtgcaatcttggctcactgcaaactttgcctccagggttcaagcgattctcctgcctcaacttcctgagtagctgggattacaggcgtgtgccaccatgcccggctagtttttgtatttttagtagagacggggtttcaccatgttagtcaggctggtctcaaactcctgaccttgtgatctgcctgccttgcctcccaaagtgctgggattacaggcgtgagccaccacacctggccactaattttgtatatttagtagagatggtgtttcatcatgttggccaggctggtctcgaactcctggcctcaagtgatccaccccactcagcctcccaaagtgctgggattacaggcgtgagccactgtgtttggcctcatgtacctttttgaatcgtgttagaggacatgttcattaaggagtttattttggagattggtggattttattttctgatcagtatttctaaaggactctaagagatttagctgaaagtataaacttttgcttttaaaaaaagttatctcttacaaggctgttttactcctgttgattatagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggaggtaaaagtttatgaaaactttttcataaagtagatacatggaaagtcttccattcttccctcctcttccctctaatattcacagaattgcataaccatcaccacatctaattttagaacattttccttaccctaaaaaggaaccttatacccattagcagtcactcctcgttctacctgttgttgtcattgtcatcctgcccccaccccccagctcctcctttcctcctttcttgccagccctaggcaattaccaaccactaatttattttctgtctctatagatttgcttattttgggcattttatataaatggaatggtacaatatgtggtcttttatgactggcttcttttacttaccgtaatgttttcaaggttcatccatgttgctgcatgtatcagaactttattcctatttattgccagataatattccatcttatgggtataatgcattgtatttatcctttgatcagctgatgggcttttgggttatttccactttttggctgttataagtaatgccgccatgaatactggtcataagtttttgtggatatgtgtttttatttcttttggtatatgcctgggagtagaattgctaggtcttaaggtttaacattttgatgaattgccaaactattatttaaaatgatgatacaattttacattcgcactagcaatctatgagattcaaatttttccacatcctcaccaagacttgttgttatctcttttcttattgtaaaaaacacataacataaagcttaccatcttaactctgatttttttttttttttgagacagagtctcactctattgcccaagctggagagcagtcatgcgacctcggctcactgcaacctctgcctcccggttcaagagattctgctgcctcagcctctcaagtagctgggattacaggcatgcgccacgaggcccggctaattttgtatttttagtagagatggggtttcactatgttggccaggctggtcttcaactcctgacctcaggtgatccgcctgcctctgcctcccaaagtgctgggattacaggtgtgagccactgcatccagcctcatcttaactatttttaagtatatagttcagtagtgttaggtgtattcacattgttgtaaaacagatcttcagaacttttcatcttgcaaaacaaactctatacccgttaaaaaacaactctcccttttttctggcccccaccctctggtaaccaccattctgctttctgtttctatgtttcactactttaaatacctcatataggtggaatcatacagtattgcctttttgtgacttgcttatttcacttagcataatgtccttaaggttcattcatgttgtagcatgtgacagaatttccttcttttttaagactgaaaaatgggccaggcacagtggctcatgcctagcgctttgggaggctgaggcgggtggatcacctggggtcgggagtttgagaccagcctggtcaacatgatgaaaccccgtctttactaagaatacaaaaattagccaggcgtgatggcgggcatctataatgccagctccttgggaggctgaggcaggagaatggcttgaaccctggaggcggaggttgcaatgagccaagactgccattgcactctagcctgggcaacaagagtgaaactctgtctcaaaaaaacaaacaaacaaacaaaacagactgagtaatgtactactatatgtatataacacattttgcctatccatttttgtttatcttttggatatatgcccagaattgggattgctggatcatatggtagttctctttttaatttttttgaggaacttattgtccatagcaattgcaccattttacaatctaaccaaaagtacataatgactccaatttttccaaatgcttacaatttgttattttctatttttttatggttgtgttatctgacttttaaaaattttagtcatctggctcagcacagtggctcatgcctataatcccagcactttgggaggctgaggcaggtggatcacttgaagccaggaatttgagaccagcctggccaacatggtgaaaccctgtatctactaaaaatacaaaaaaattagccaggtttggtggtgcatgcctgtagtcccagctactctggaggctgaggcaggagaattgcttgaacctgggaggcagaggttgcagtgagccaagattatgccactgcactcccgcctgagcgacagagcgagactctgtcttaaaaaaaagtaaataaaaatgttagtcatcctagtgtatatgaagtggtatatctcattttgatttgcatttccctaatagctaatgatgttgagcattttttcatgttcttgcttattggccatttgtgtatcttggagaaatgtctattcgtatcctttgctcctttttttaaaaaataattttaagttcgaggatataagtgtaggtttgttacataggtaaacttgtgtcataggggtttgttatacagattatttcatcacccaggtattaggcctagtacccattagctttgcttattttttaattgacttatttatttttttattattgagttgtaaatgttctttatatattctggttacaagtcttttatcagatatacgacttgcaaatgtcttctctagttctgtgagttgtcttcattttctcaatgataacatttggagaattataattttggaacactagtatattttctaattgctttgtattctaatgagaattagatcagagatgatggattggtttaccctgatttatttatatttaaaaagcttatgtttaaaatgtgcttcaaagagaaataatacccataagatattcgtctaattccttataggcacttaggaacaaatactttaaaagatgcatttttagtaataatctgttagtctaagaaaagtggtaacaggaaaagccaataatttattacgctttgttttccatgtcatcttggttactagtttatattggttggcttctttcctccctgtagggaaaagtaatagaacctctgaaagattttcataaagatgaagtgagaattttgggcagagaacttggacttccagaagagttagtttccaggcatccatttccaggtaaaaattagaactgaattttgtttgattcatctttagaccttcatgttgaagaaaaatcaattcagacaattctgaaataatctgtcatctcagggaatatgtaacatgagagaaaggaaaggatggttagggaataattgaaatcttttgagtatctactgtatttacttcattttattaaatactcattttccattgtatctgcatttaagtgttacattatccttgggagtctggcatctgatgttgccatcagatgagaaaaccaagacataaagatattttaataatattgccacacagtcctagtagtagagctaggatttgttatattatttgtaccataccgcagtgcgttccatggaagatgtgaggatttaaatttagctctttaaaatccttgtcctatgtctgacttgtttgaatggatgaaccacttattctgtgcagagaattcctggcacaatgtaactaattcctgaacaaataatacttcatttgctgtcatatagaaaaaaattagaggtgatacttgtttaaagttaggactgcaagtcttaacctgtttttgttactagttcttgagaggttgggcaagtctgtacatcaggttctagctcactgtaatagtgattaggggatgatttgggagaatgacctaattgaattgaaaagcataataatagccaacatttcttaagtactttctatgtgctaggcactctgctaaatacattttattgtcttatttaatcttcacagtggaaactactattatcctgttttacagatgaagaaacttagggacagcgactaatttgccaaaagttatgcagattgaaaggagtggagccagaatgatatccccaataatttttatctcagagtttatactcttaatgatcatattggctccataaacagctttacacatgtataacctatgtggtgattagcacttgttctcaaatcaagtaatcagattgagatctttagtccctaacctgcatgccggcgaagaatggtctgtggaccggtgtggtggctcatgcctgtaaccctgagtctactaaaaatagaaaaattagccaggtgtggtggcatgtgcctgtaattctagctactcgggaggctgaggcaggagaatcgcttgaacccgggaggcagaggttgcagtgagacaagattacaccacagcactccaacctgggcaacagagcatgactccatcttaaaaaaaaaaaaaaagaaaaaaaaaaaagaaaagaatgatctgtgaatgtaatggagggaagccaagtgttctatgtccttggtcattatttcatctagactcacttgatgttttaaaaatctattttgtatgttgagttttctattatgtaagacttcattggcaaaaatggttttactgctttaaaaactatcttaagtatgctgtttattctaaaggtaaagaatggactagggaattaattggacatagctgaggttttgcctataactaggcatctcaagtgatgccttttctgttgtagtaaagcagcaggatccagttttccatagatctatgcacaccttgtgtttttatcaacttttaagtatttggtaaaatagaggttgggtacagtggctcatgcctgtaattccagcactttgggaggcctaggcaggcagatcacttgaggtcaggagttccagaccagcctggccaacgcggtgaaacccgatctctactaaaaatacaaaaaattagctgggcatggtggtgcatgcctgtactaggtacactggtggctgctaggggagggtaaggcaggagaatctcttgaacctgggaggtggaagttgcagtgagctgagatcgtgccactgccctccagcctgggtgacagaatgagagtctgtcaaaataaaatagaaataccagttcacattttttggtattaaaaactcacattatttattagattatgtgtatattttaacagtataataccattcctaaaattagattgatagttgaagctggatgataagtaaggtagttaattatactgtcctctttatgtatatgttggaaaattcccttattaaaaactttggatgagcacatatgttataaactaaaaatatttactggataattttgtgatacttaatacatggactgtaaaaataggataggccaagtgcagtcagtggctcatgcctgtaatttcagcatttccagaagccgagcttctggagttcaagaccagcctgaacagcatagtgaaacccctatctttactgaaaaaattagccaggcatggctgccggtgcttgtaatccaagctatttaggaggctgaggtgggaagactgcttgagctcaggaatttgaggctgcagtgagcaataattgcaccactgcactctagccttggtgacagagcaagactctatctcttaaaaaaagggagataggaatgatagggagagaattaaacatactgtcttatttgagcctcacaatggaaactatgatagtattaccctgttttatagatgaagaaacttagggacagagattaatatgccaaaaagttatgcagactaaaacgtatgcataatttaaatgttgcagcattctaaatgttacaacatttttagaatgttgaagcattctaaaaaatgctgagttgaatgggaaactaatagctacatttggatacttatgatgggcagatggattttaattttggaaaggttttatgttttgaaactagtggcatttttatattagatttttatattagaaatataacattaatgttaaatactattattactcctacctttaggtcctggcctggcaatcagagtaatatgtgctgaagaaccttatatttgtaaggactttcctgaaaccaacaatattttgaaaatagtagctgatttttctgcaagtgttaaaaagg

SEQ ID NO: 14894 - DNA, 105 bp, Homo sapiens
ttttttgtatttttagtagtgatgggatttcaccatgttagccaggatggtcttgatctcctgacctcgtgatccacctgtctcggcctcccaaagtgctgggat

SEQ ID NO: 14895 - DNA, 197 bp, Homo sapiens
ggggttttaatttatgtaatgtgtgtggtctgaaaattgcaacgaaataattttaaagtggatctgggttggtagtgcttatgggagttaggcaaggaaaaatgcagattctctttagaatatcttcacctaggtcccaaaggattctcatagatagatttccaacaaatatgaggttataataaaaaatacaaatc

SEQ ID NO: 14896 - DNA, 1033 bp, Homo sapiens
attttttgtattttttctagagacggttttcgccatgttgggcaggttggtcttgaactcttgaactcctgacctcaggtgatccacccgtctcagcctcccaaagtgctgggattacagcatgagccactggccgacttttgcttcctttacagattactttgcagattgacatccaggctatacccttgtttatgtgagcgaggctgtgttgtaggcactggcactatacttacacagaagttggcaacttctcattgccttgcacaaatgtggataatagtaataacaaactaatgttgaatgattagaattttaatcagttctttaaaagtagccattattttggcatgttaggtagggagagattcaaattatttatgttatcttcccaacttgagaatggcattattagatcaagccattagacttatagattgcggaagatttagatgtacttcttaattatgaaaattacatttaccttactcaaataaccccatatatacctaaaagttttaataaactaaagcatgaccacatgactcaatcagctgtccgtaataacctgtggtataggtaggacttagttgggcaaagggtgagatgtggccatcttcacgggctcataagagataaccaaggtcccttcaggtcggccagcctcatcatgcctcagctctttctaatcctgcttattagtaaggtggatgtttattcatttatttatttggttagttaaataacaggccgcaatttactgtgttacttaaattttacttaagtaaaatttaagaagaagaagaagatgatgactgtaaaaacaaaggtgtgaatatatttagctatacatgagataggatatcaaatacataaatagttcaatttgcagttgcacagtgccatttcacccaggttaaacaataggaagactcgatgcatacgtgtcatctgtaaatgctctcatgtgaaagaaattgtgaagtaaaataaagtatcttgagtagaaatttttctacattttctcaaaata

SEQ ID NO: 14897 - DNA, 1033 bp, Homo sapiens
attttttgtattttttctagagacggttttcgccatgttgggcaggttggtcttgaactcttgaactcctgacctcaggtgatccacccgtctcagcctcccaaagtgctgggattacagcatgagccaccggccgacttttgcttcctttacagattactttgcagattgacatccaggctatacccttgtttatgtgagcgaggctgtgttgtaggcactggcactatacttacacagaagttggcaacttctcattgccttgcacaaatgtggataatagtaataacaaactaatgttgaatgattagaattttaatcagttctttaaaagtagccattattttggcatgttaggtagggagagattcaaattatttatgttatcttcccaacttgagaatggcattattagatcaagccattagacttatagattgcggaagatttagatgtacttcttaattatgaaaattacatttaccttactcaaataaccccatatatacctaaaagttttaataaactaaagcatgaccacatgactcaatcagctgtccgtaataacctgtggtataggtaggacttagttgggcaaagggtgagacgtggccatcttcacgggctcataagagataaccaaggtcccttcaggtcggccagcctcatcatgcctcagctctttctaatcctgcttattagtaaggtggatgtttattcatttatttatttggttagttaaataacaggccgcaatttactgtgttacttaaattttacttaagtaaaatttaagaagaagaagaagatgatgactgtaaaaacaaaggtgtgaatatatttagctatacatgagataggatatcaaatacataaatagttcaatttgcagttgcacagtgccatttcacccaggttaaacaataggaagactcgatgcatacgtgtcatctgtaaatgctctcatgtgaaagaaattgtgaagtaaaataaagtatcttgagtagaaatttttctacattttctcaaaata

SEQ ID NO: 14898 - DNA, 1033 bp, Homo sapiens; identical to SEQ ID NO: 14897

SEQ ID NO: 14899 - DNA, 1110 bp, Homo sapiens
caggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacagactgattggaattctttctgttgaaaagcacacacaataaagaacccctcgttagccttcctctgatttacattcaactctgatccctgggccttaggtttgacatggaggtggaggaagatagcgcatatatttgcagtatgaactattgcctctggacgttgtgagaattgtgctttcaccagaatttctaagaatttctgctaaatatcacctagcatgtgtaattttttttccttgcctgtgacttggacttttgatagttctataagaataaggctttttcttcccttgggcatgagtcagatacacaaggacccttcaggtgttactagaaggcgtccatgtttattgttttttaaagaatgtttggcactctctaacgtccactagcttactgagttatcaggtgcaggtcagactcttggctacagtgagaggcagcttctagacagagttgcttaatgaaagggtttgtaatactttacaaaccattacctgtacctggcctggcctccaaaatattaacattctttttctgttgaaactcgcgagtgtaactttcataccacttgaatttattgatatttaattatgaaaactagcattacattattaaacgatttctaaaatc

SEQ ID NO: 14900 - DNA, 102 bp, Homo sapiens
aggctggagtacaggggtgcaatctcagctcactgcaacctctgcctcccgggttcaagcgattctcctgcctcagtctcccaagtagctggaattacaggt

SEQ ID NO: 14901 - DNA, 1110 bp, Homo sapiens
caggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttttgatgtatatatctattattcaaaaaatcatgtttattttgagtcctaggacttaaaattagtcttttgtaatatcaagcaggaccctaagatgaagctgagcttttgatgccaggtgcaatctactggaaatgtagcacttacgtaaaacatttgtttcccccacagttttaataagaacagatcaggaattctaaataaatttcccagttaaagattattgtgacttcactgtatataaacatatttttatactttattgaaaggggacacctgtacattcttccatcatcactgtaaagacaaataaatgattatattcacagactgattggaattctttctgttgaaaagcacacacaataaagaacccctcgttagccttcctctgatttacattcaactctgatccctgggccttaggtttgacatggaggtggaggaagatagcgcatatatttgcagtatgaactattgcctctggacgttgtgagaattgtgctttcaccagaatttctaagaatttctgctaaatatcacctagcatgtgtaattttttttccttgcctgtgacttggacttttgatagttctataagaataaggctttttcttcccttgggcatgagtcagatacacaaggacccttcaggtgttactagaaggcgtccatgtttattgttttttaaagaatgtttggcactctctaacgtccactagcttactgagttatcaggtgcaggtcagactcttggctacagtgagaggcagcttctaggcagagttgcttaatgaaagggtttgtaatactttacaaaccattacctgtacctggcctggcctccaaaatattaacattctttttctgttgaaactcgcgagtgtaactttcataccacttgaatttattgatatttaattatgaaaactagcattacattattaaacgatttctaaaatc

SEQ ID NO: 14902 - DNA, 17367 bp, Homo sapiens
accatggtctagcggtagcatcagtgtcaaggaaaaacacccgctacttagcagacctgcaaagggagtctccctttccctgggggagtttggagaagactctactcctccacctcttgtggagggcctgacatcagtcagacctgcccgcagttatccgggggactgtctccctgtgatgctgtgcttcagtggtcacgctcctagtccaccttcatgttccgtcctgtacgcctggctctgccttttagatagcagtagtaaattagtgaaagtactaaaagtctctgatatgcagaagtaatggcataagctgtctctctctctccctctctgtctgcctcggctgccaggcaggtaagggccccctgtccagtggacacataacccacgtgaccttacctatcattggagatgactcacactctttaccctgccccttttgctttgtatccagtaaataacagtgcagccagacatttggggccactaccggtccccgcgttttggtggtagtggtcccccgggcccagctgtcttttcttttatgtctttgtcttgtgtctttatttctgcagtctcgtctccacacacagggagaaaaacccaccgaccctgtggggctggtccctacaaagataagggtgatagtatctcccctcaagtgttgccagaaggaccaactaatgccccacaccgagcaggcacttgatggatgatggcatttacttagaaggaaggagacgattctcattttttccaccagataaaaactaagatacatgggtttaaaaaatgggccttttgggaattaagggcccagaatgaaacatgagcctcctggcctttcctggatcaccgtcaggcttttattgagagaggagcagctccccactggctgcttggcttgtcattgcttcactctgtctcctttggccttgccacagatctacgcagaccccaccaagaggctggagctgtacttccggcccaaggacccatactgccacccagtgtgcgccaaccgcttcagtaccagcagcctgctgctccgcatcaggaagagaacgaggcggcagaaaggggtgctgggcactgaggcccactccgaggtcacatttgacatggagatccttggcatcatctccaccatttacaaatttcagggtaactgaaatctgctcttgcaatgtctggttatttcagggctggccatcctagctgcctgcaggagctgtgtgggtcatctgcaccagtggagggggccaggatatgcccaggggctgtggggacacagcagggcacaggccccatccaggaggcagcctttcttccctccagccaacagttccccagagactgcaggttcattgctgcccaatcttcagcattcttaagctagaaatctcctaatttttaatgaaaccattgtgtgggaccaaataaaactggtcagtagacctccagtctttcccccaccacagtgttttgaaccttctcttgtctcggctgctgttggtcttgccctcctagctcccgaagccccttgggacctcctcctcctctgaactctcagcaggttgaacgtccctcgtggagccctcaatcaggtttcccacctaccaggaaccccagtgaggaagcaataaagcaagggagggagacgggtgagaaagacagactctggcattgtgcctgcctgagccctgccagtttctttgggaggtggcttggcttccctgagcctcagtgtccttgtctgtgcagtgcgggctacagagcctgcgttccttaggccctcgtgaagattccgggaggcaatgcttgtgaatgggccagcctctggcccacaggaggtgcctggcatattactaacaaggcttagagatggctaagttacatctgcagttctaggcagaatctgaagagtataaagattgagaagggcaaagagtactagaaagaaaagaggggaagaagaaagtgaaatgaaggagaagcaggacctggggtcccatgggttgggcatttttaatggcagtcattctggtgggtcatggcattcaccaaagagggctgttcttttgggacaaggtttcccaagtgattcataaaacataacacctcatatttttcatcgaattgaaccagcatcttgctgctctgtgtgtgtctctggactggcagcatcagcctcacctgggagcttggtagaaatgcaccaggtcagaacctgcatttagcaagatcccagcagattcatatgcatgttactaggttggtgcaaaggtaattgcaggttttacagttaaaagtaacattcatctaagaagcactgacctggactccatcctcacctatcatgtagctccccacctccccaaaataattttcatgtaagtgacttagactgcatggagccaactttgcagaggcatttgggaagggtgtgttttcctgccaccctcaccctgcagcctccaccacatggcccactcagcacctccctaagcagatgtgggtgtcggtgtgtggcagctgcccattcctggactcaatgtctgccatctgcccacctctctttctagggatgtctgacttccagtacttggctgtgcatacggaagcaggcggcaagcatacgtcaatgtatgacaaggtgctcatgctccggcccgagaaggaggcctttttccaccaggagctgccgctctacatccccccacccatcttctcccggctggacgccccggtggactacttctaccgaccagagacccagcaccggtaaggcccccctccatgcagcctcggttctctatcctgaaaatgggatggtccgggcacggaggctcacacactgggcgtggtggtgcacacctgtaattccagctactcgggaggctgaggctggagaatcacttgaacccaggaggtggaggttgcagtgagccaagatcgcgtcactgcactccagcccgggtgacagagtgagactttgtctcccaaaaaaaaaaaaaaaaaaaaaaaagaaaatgggatgacagtagtactacccaacagacgtattgggattgaatttaaaaagtgtgtgcagttctcagcacagggctgagtacagaacagggccttagtaagcggtggcctgtgtgatcgccaggttggcctcagtcctgaggacagtgcaaagaacgtgactgtgggacatgtgggttcctgctgagaaatgtcctttggcttaatcccctggtcattgctgaccagccagtctctggaccttgctgtcactagtaatgacactacctaagcaagcctcgtgggaatgtcccactctctgaccccagctctttcctacttcctttgctccccatggcctcaccgtccctgtccgtggcggagattttgcagcctctttatcatctgtccctgccctgccctcctctctttgccacactcacctgccaagccttggtcctacttcaccccagctgtttaccctttcctggtctgccctgtgcggctggaggtcgcttcagagaacccctgaccctgcccatcgcccagtgccatccttctcaaggcatctgtgactctacacagctctcgcctgctctgtacttggttatggactgcgtcccctccagaacacggtgcctctcctgaggacaggcgctcactctctctcatcagtagtgggtttctcctacaccgagagctatgaaaagccacatggacgtgactcatagtgcacccaccgccaccccctgccacccacacacaggctccgtgcacagcctgcccaagcccacatgcaattcagatgaaatgaattctgtaactcagaggttcttgacataattagagacctcagcggctgttggaaaggcaggcctgggcattgtcaaatgtagtcaaattgtcaaatgccatacattgacataaaagaataggatttcctttatataaaatccaagattgaatactgtgaaaacaaaatgaagaaaacaagtttgacagtatccaactggggatgaataacattgaccagccacactgccagttatttcacgtccctgtgcagcagcgctgtgagtgcatctcacccaagcctgggagcaattccccagggttcctgacacccccatcgtacacatgaggaagccgagacatggggtcagcgccacgtcccgccggcagcaccgccctggtctctcccactctgcaggctttgctcgtggcccagtgccaacggtgtcctgatttttgtatgctctactttctaaaatgacgcacaaaaagacaacatggaaaaaaactttgcattgtaatggatgctccccagaagtagcgacttggcctgcttcggtctctgtcatagccccggtgcccagaacagagcctggcctgtgagaggtactcagcaagtgtccatgggccccacacagatttaggggagcaagattactgccaacagatgagcaaaatgaaagggcctttttttctttttctttttgaaaggcggagtcttgctctgtccacccaggctggagtgcagtggcgcgatcttggctcactgcaacctctgcttcctgggttaaaacaattctcctacctcagcctcctgagtagttgggactgcaggcgcccaccagtacgcccagcttatttttgtatttttagcagaaatgaggtttcaccatattggccaggctggtctcgaactcctggcctccagtgatccgcccacctcagcctcccaaggtgctgggattacaggtgtgagccacagtgtccagcccgaaaaggactttgaaaactgggccagaggtgatggtgtttgttgaataattgttccatagcatgttttaagcttccaaaaatgcagccctcaagagaatgggcttgggcctagtgtagtggctcacacctgtaattccagtgatttgagaggctaaagtaggaggatcacttgaggccaaaagtttgagaccagcctgggcaatatagcaagactctgtctctacaaaaaaaactaaaaaagttagctgggcatggtggcgtgcacctgtatagccctagctactcgggaggctgaggtggaaagattggttgaacccaggattttgaggctgcagtgaatatgatcacaccactgcactccagcctgggtgacagaacaaaaccctgtctcaataaacaaaacaaaaaacaaacagaaaaaagagcggactctgtggactgatgggacccatgcccaggtgcctcccttgctctgtgagaaaggcaggtgcaagaccagattctgtggaatagaaataaatggtggtgtgataacagaagcctagaaaagtctggaagatttggggctcagagcagttttctttgaaggggtgggagggctttctcattcctcattatgtgtttcctttatgtcctgactgagcacctgtggtggcccagggcactccctggagcctggtgtccacggacagcacagcagctggggtgcagtgcaggggcggggagctagacggagcatgagtacatggctgggagccttaaaggagatcatggggagtgggccacactggtggaaggcagtgggccggggctacaggtagcagcgagggccctcagaggagctgacatctggagctgagacagagccagccaggtgaagatccagggagaactttccagaccaggggattggcgcatgcaaaggaaggctggggaggctgctgtgccccagagcaggtgagccagagaatgggggtggggagtgaagaccagtgcctaggcttcatcctcaagagagagtgtgttattctctgcctccggaaaagcattgcagaaaggtggagagaattggattgtctagtagcccccacgtgcccatcaggagcgtccagtgagcaacattctgctcctctccacccccagtggcacagtgctgccttcagaaacaagcagtgcggatctctgacagggaagactcatgtttcagacagactcgcaataccagtctcctacgcaacagaattaatagcactccccaacatcacccacaaccagtccttgttcactttttcccgattgtctcaaaagccactcaggagccaaacaagggccacacatgttgcttttggttgctgtcccctagtctgtaacatcctctaccaccaccaccccctacttttttctgattgtaagaataaattgtacctgttagaaaaaaacaaaacattgtggaaatgtattaactaaaaagaatcaagtcactttgcctccctgcagaaaactgttgcacatagaatgataccattttctgtaagtgtattgtactcactataagagtttgaagcagggggtgacatgatccttcctttttttttttttggagacggaatttccctcttgtcacccaggctggaatgcagtggcgcgatctcggctcactgcaacctctgcctcccaggttcaagtgattctcctgcctcagcctcccgagtagctgggattacaggtgcgcgccatcacgcccagctaacttttgtatttttagtaaagacggggtttcaccatgttgaccaagatggtctcaaactcctgacctcagatgatccgcctgcctcagcctcccaaagtgctgggattacaggcgtaagccaccgcacccagcctattttttaaagttacttattggccaggcatagtggctcatgcctgtaattccagcactttgagaggctgaggtgggaggatcgcttgagcccagaagtttgagaacagcctgagcgacatagtgagaccctgtgtctacaaaaattttttttaaatcacccaagtgtggtggcacgtgtgcctgtggtctcagctacttgggaagttgagatgggaggatggcctgagcctgggaggtcaaagctgcagtgagctgtcattgtgccactgcactccagcctgggtgacagagtgggaccgtgttttaaaaaaaaaaagtggttttttggtttgttttttcttcaccacaagcagcatactcttgtcagaaacaaaaatacataaaagaaaacagactgggcacggtggctcacacctataatcccagcactttgggaggccgaggcgggtggatcacctgaggtcagatcaagaccatcctggctaacacagtgaaaccctgtctctactaaaaatacaaaaaaattagccaggtgtggtggtgggcgcctgtagtcccagctatttgggaggctgaggcaggagaatggcgtgaacccgcgaggcggagcttgcagtgagccgagatcgcgccaccgcactccagcctgggcgaccgagcgacaccccatctcaaaaaataataatatacaaaaaattagccgggcgtggtggcgcatgcttgtaatcccagctacttggggggctgaggcaggagaatcgcttgaacccaggatgtggaggttgaggtgagctgagatcgtgccattgcactccagcctgggcaacaagagtgaaactccatctcaaaaaaaagaaaacagcacttgtcagcactgccgcccctggcactagatggcagcagcatctgagttactgctctgccctgtgggccagtgggaagctgtttccagcccctggggtaaaatgagggaggagggccagctgccctcgggccccaaggcccccctccctccccatgtggtttatcagtttccagcacctggaaagaacctgcattttctcccagggctgctgtcgattctcctgccctgctcacgttgctgggtgcatgaggactggcagggaggagacctagccactgcctccttggccccttcctggggagattgagcttcccacaaaccaggtgggcaagcagaggctgctgggtggcctgacggggtcgtcctaactggaggatggtgggtccctcctgttcctcagggactctccaaggtggtcctgttgactttgccatcagcacccttcgacccctgccagcagttccccacctacttagaatcatggtgacacagaccacagcctgaggccaccatggggagcggtctggggatgcagccaaggctgccgcagcctctccctacagggttgggcacaggtgggctgctcttgcaggtgaccacccggttttcctggggaacatctttgaaaacgcgatagtgctgacctgtcccgtgcggtttctaacgcaggcactttaaaaagaaggcccaggctcgatcccgtctttctagttttgtttcacaatgtgaaaattactgctattctttgtaagtgtgcagatgctatgtactcatgtagaaaactaaggtaaaatggaaacacattttaaaaggtaatgatcacccgagtgaatttgatgatgtccgagacctactttaagatgcacttcgatgaaatgcagttaaccatgtgctgatcattgctgaagctggtgacgggcttgtgggggttctttacactggcctgcctgcttttgtgtcagtttggtgtccaaccttaaagacgtaactactacaaatattttgagaaatacctacctaagggtgttctgtgccaacatacagaggtagttctagaatctctgctttgtatgtgtgtgtatgtgttttaagactttatttttttagagcaattttagaatcacagcaaaataaggcgcagcgatttctcctatgccccccagccacccccactcagcctcccccgtgatcagcatctcagtagagtggggcgcttgttaccagtggatgaacctatgctgagacgtcgtcacccagtgtccgtagttgacattggggttccctcttggtgttggacattctatgtgtttggacaaatggaacccttggctttaacccctgtgtttcatgacaatgccatttggtgaggttctttgttcattcatctacatgtggtcgagatgcttgtgagccaaagagtcatgctctgttgggtggcaggacaggtgtgtgatgggacctttgcagccagccttctcgatgggagtcccagctccttcccaggagctccgtctctgggcaaatttcccagtccctgtggtttcagctgctttattagaaaatggtcccttctctgtaggattagtttgagcgttaaataagtgaatcgcatgtaagcagatgtgagtgagtgcagctcttgtccctgttttgacaacggattgcgttctctcatgcagctgtgctgggtgatttcaccattgccagctgctggacattagactctgtccagtttttcactggctggacagtgctgtgcctgactcagtgcacttttggggccaccagccccatgacaggtgccctttcctgcactccagcctctaggaccttttggcctttccccagtttgagagctgcaggccccagggtttctctgagttgtcataggcagttgtggctgcgtctcttcctctgtgaatacaggttcctttagcagccaactctggggtcctttcccagcacagatgtccagagagaggcacacggtggctgtgggccttggggggttctgggctccctgcctggtctggcccagcgggtgcctgggatggccttggtgctcctgttctcacctgtactctctgcccccagggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaaggcaagtcctgcgctgcgcctggccccggtggctccagcctctctgttggcttcccgtgtttacccagctgctccctgttcctggctgtggggttggctgcactgacctttacccattccttagtgcatgggaacttctcaccttcagatgccatgtctaaaggctgtgtcggtataagttctacattcccaaggttgaaaatgcttcttagagttcttaagaaaaatatgcgtgcgttgttcagatgtgacataaacgtggagctctgggatccactgagctcttattcttccattcactcattgcagccaagccagtggggcacctagtgtgccaggcccagcactttcttaccgttagaactggaaccgtgctgccaggcagccctccttccccgggcttgcgggtgccgtggagtcctgcgtccccactggcatgagcatcaggttcacaggccactgccacctggagcccggcgcttcccttacgcagtgtgcctgtgggagaccacgtggatgtcttgttgatttccagcagtcactggggcacactgtcagtggctccttattgcccaccaggcacagcccacattcctgacctgaattggctcgtgaggcccgctgccccagccccctggccctctacactccggccacactgacctttgcagtcctccccgggccaggctgtccccttcagccctgacgatgtcccacctcaggcacctgttctgtagattggggcagcatggggaccctgggactctagcatgtgccccctgagccgtactccccaccgcgctgtgggctctatgaggacagcgaccatgtctcttatcgtttgagagacccagccccacaactgcacttggcacaggctgggcatgcagcccaggcttctgagggaagggatgaattagtgagagcaggaggtcctagggccacgccctgtgtgtccagcccctgtcctctaccagctcctctctggaggggccgctggggcccagaacatgttgggagttcagggccgaagggtggaagctgctggtgctcatctcagcctctgcccttggcctccccagctgtttgacatccgtcccatctggtcccgaaatgctgtcaaggccaacatcagcgtccacccagacaagctcaaggtcttgcttcccttcatagcctattacatggtaagtgtcagctgcccacccacctgccttggtttccacccatgtggtccctggtccctgctgtgatgtcttagagccacagtaagagcagccaaccccctatcctggctccccatccttcctgccccacccccatcctggcccatccttcctacccacccctggcctggccctcatccttcctgccctgcccccaacctagcacctcccccgtcctggcacccccatccttccttcccccctgtcctggccccccgatcctagcatccctaagacagcttattaaagccagctagaaaagtttcagctccctgagtccagggcgccctccacagcctgttgggctgcagaacccagcccctgaccacagcggccccatgtcgtcctctacctgtgttgagtggggttcagtgggaggcagatccacctttgatccacaagcatgtaaagacacatgtcattactgaggttccaaaggtgctggttggaaagggatcctccccgctgccaggcctcacagagcattaggggaggccagcgtaagacatgactgtgagggtctgcaacaggcagtaggacacaagaaagactcatttcttctgccttgttggacttccggctcaggagagcgacctgtgctgcttggcgttggcattttattttattttatttattttatttattttgagatggagtctcactctgtctcccaggctggagtgcagtggtgtgatctctgctcactgcaacctccgcctctgggattcaagtgattctcctgcctcagcctcctaagtagctgggagtacaggcgcacgccaccatgcccagctaattttctttttttgcatttttagtagagatggggtttcgccatgttggtcaggctggtctcgaactcctaacctcaagtgatctgcctgtctcggtctcccaaaatgctgggattataggcgagagccactgcggctggctggcattggctttttagacataagccattcaaaagctccgtttagggacagaagatgtctcatcgattaggccagtagtaacattgggcacttaatatgtgccaggaaccatggtaaaggctccacgggcgctatctcatttaatcctctgaaaaaccatgggaggccaggcatgatggctcactcctagaatcccggtacttcgggaggctgaagcgggagaatcgcttgcatccaggagtttgagacgagcctaggcaacataatgagaccccatctctacaaaaaaattaaaaattagctgggtgtggtggctcgtgcctgtagttccagctacttgggaggctgaggtaggaggatcacttgagcccaggaggttgaggctgcagtgaaccgtgattttgccactgcactcagcctgggcaacagagtgagaccctctcccccaaaaaacaaaaacccacaggaaagggtgctccttttccctccatctgacaggaagaccaaggtttggaaaggccacgtgccctcaccaaggtgacagggcctgcatgtggcagagcagggctgggcatccagagccctgtccccagctcctgagctcttctgctgcctcactgtaggctctggcccgtccagggacctgggccttcacctcacctcacattttccccacttttctgtcccagataacaggcccctggcgcagcctatggattcgatttgggtatgacccccgaaaaaacccagatgccaagatttatcaagtcctcgatttccgaatccgttgtggaatgaaacacggtaaaaattcctgaaagctttgcttcctgcctttctctctctttatctttcagtttctagcattctcttttgtagtaagaatcttttcatttggaaagaataaaaaaaccttttgcccccgttgctgagactcttttgaatgcagaatggcgtggaaacgaaagtcctagttctgtgctggccccaccactgaccgcccgtttctgaaccacagtccctcattaagtgactccacgtgccctatggtcctgtgatgcaggccaggcacttgtgagagcatcagtgcccgccctgcctgggaagtgctgagatgtgttggtgaccgcagtggcgtgcttggcagtctggggttgccctctcaggagctggccccatggacccaactcccatctccagtgtgaagccagtgttgtgtgccgacgggccctgtgcccgcccacctgacttgcccgccctcgcctacaggttacgcccccagtgacttgccggtcaaagcaaagcgcagcacctacaactacagcctccccatcaccgtcaagaagacatgtaagcgtgccaggcgccttttgtgggtcatgagtgatttgccaaggaaggcggggcacctggacccagacggggaggtggttcctgggggtcactccagggctctgccggtcattcctcccctaggagggggtgggctggcaggagggcagggcatggtggttgggagagacacctcctccccaccctgcacattccaagcactgctgttgtccccacgcagccagccagcttgtcaccatgcatgacctgaagcagggcctgggcccgtcggggacgagtggtgctcggaaaccagcttccagcaagtacaagctcaaggtgggcgcccctggaggccaggaatggaggggaggacttccctcttggggccgggcaccttgtgggtgacacctggggggctgtgattagggcagctctgcccaccggggcctcggcaccttgcttccttttaggtcagccttcagacactgagggtgagaactcgggtgcaaagccccagggctgtgtgtgttggggacatctggcgaagaggtggtgacaagtctcagggaagtctggcaccagcagctgcatgtggttgtccttctcgagccctttgggagcctgggcccccactgagccacgtgaccactccgggaatgatcggaattgggcacacacaggaggacagagccagagcaggccatgtgggctgcagctgtggcaggagcctcactggctcacgtttccgtcagtgcggttgcccagcgggggttggcggtttccagagctgttcccacattcaggctcccgcaagccgctccacagccctgggggaggccgagaagggggcatcccgcacggtggaatcacctgccgagggagtgggtggcagagatgagtgcagcagagacgggtgatgcgagggacttgctgtcccccagtgtctggggccctgcctattttctaggttttttagacctttgctgccttcccagtgaggggcgatcatgccacagcctgtgcggccttccttctcgaggcctctcctaggaggccgttatccttactctagaactacatggctgggtacggaaaggagagagcaaacactcactaagccctgcttttcccagaaaagatgtcagggcagcccatagggggacatagggtgacaaattagcagcagtgggtgagggataaggtcagagtgcaggagggcacagagagcagagcccggcacaaggctagtgccagccccatgccatgggcgccatggcctgctgcacgggcgggctcaccgtttccagtggccccaggagggcctgggtgctcctctgcctctcccagagcctcctggggagttggacattgttttttccccaactcctccgtggccttccagcctgtctgcccaacctgctcctggtgaccagccagctccctggagagaccccatgggagcctacatggagtctgcaacactggcagccccagggctctggctcaccttccctgtctctctccccctttgtcaccaggactctgtctacatcttccgggaaggggccttgccaccctatcggcagatgttctaccagttatgcgacttgaatgtggaagagtacgtatgggaggggccctgagacactgaggggggcccgtgggacccagggaccaaagcggtctctgaactcttccacttcacgtcggccttcatctccggcaagagcactcgcctgtctgggagtttggtgctgccgagagccctggcatgctggtggccctcgtagaggcggtgccctatagaaagccgtggctccaagctgcgcagagacagttcttactgttatgtccttgctcctcttccactgtccacataaaggccccatgaggtggttctcaatcccaggacccatcagatcccagaaaccttttatcgacttgttctcagtgatgtttaaagaattgcagggaaagggcactcactgggatgagaggagatgggaacacatcaaatacatcttgaactctgctgaaagccatggttcaccagaagcatgtgcagtggtaacacggccagcttcatgtgtgtgaggcggtccagggagcacacaggtttagggccccagctgggaacacacagcttgtgtttccagttcctctctgtagacttcgctcacggggctgcctttgatctcagtacagctctgcctctggcaaaaaccaacactggcatctcttagcagagacccgccctgggactttatgtcccaaccctctccccacccccaggttgcagaagatcattcaccgcaatgacggggcagagaattcctgcacagaacgggatgggtggtgcctccccaagaccagcaacgagctcagggacaccatgtccctcatgatccggcagaccatccgctccaagaggcctggtaagagccgcttggggtaaagggggtccaggatgcctggtgatctcctttgagacagaggtgtccctaaggggacccattcctgggaaatggcacccaggtggcatcatcttgcccctggccctggtgggaggaggacattgtgagccagagcccagcccaggtgctggcatcaccccagctgcccagaggctgcctcagccgaggccctcagccctgcggtccggggcaggagacaagcccagaggggctgggtgcagcagcctggcactgccatcggggcctccacctgacgccctcacaccagcccatgtctttcagctgtgcatgcgcaggctctgcctctgtcttcttcctgttctgtgtggcccagccccttcctggaaccaggcagccctggcaggagtgagggccagctgcagggaaagtgaagggggcaacacctgccaggctgtgggtctcacgaggctcgggggagttataagaggccccctctctcagggaactcctcccaggcttggggaggaggcatcctggacccagccacgccccacagatctgaccgaagcaggggttcttggtcttgcttggaacccagattcagccccctttgggaatctaatcaagggtgtggaccctttcccagagaaaatggtgtgttcactcctgagggtccatgggcccttgaagctgctcatggctcccctgctgcaggattcccctgggtgcccgtcaaactacagcttccctggggggcctccaccccatacttacccaccagcttcttaagagctcgagctcggacccttatagtagtaaacaggctccccagagcctggtggcctttctggggccacccggcagcctgcatgggacacccatggccttgtctcctccggccccagctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagtgtggggagcctcgcccatggtctcacgtggcaagaagtgcctttagctctggatcccaaccgtttggcacagctttggccacagccaggcccctctggaattgtccttattaaaccagtttcccgagaagt

SEQ ID NO: 14903 - DNA, 6438 bp, Homo sapiens
acatccgtcccatctggtcccgaaatgctgtcaaggccaacatcagcgtccacccagacaagctcaaggtcttgcttcccttcatagcctattacatggtaagtgtcagctgcccacccacctgccttggtttccacccatgtggtccctggtccctgctgtgatgtcttagagccacagtaagagcagccaaccccctatcctggctccccatccttcctgccccacccccatcctggcccatccttcctacccacccctggcctggccctcatccttcctgccctgcccccaacctagcacctcccccgtcctggcacccccatccttccttcccccctgtcctggccccccgatcctagcatccctaagacagcttattaaagccagctagaaaagtttcagctccctgagtccagggcgccctccacagcctgttgggctgcagaacccagcccctgaccacagcggccccatgtcgtcctctacctgtgttgagtggggttcagtgggaggcagatccacctttgatccacaagcatgtaaagacacatgtcattactgaggttccaaaggtgctggttggaaagggatcctccccgctgccaggcctcacagagcattaggggaggccagcgtaagacatgactgtgagggtctgcaacaggcagtaggacacaagaaagactcatttcttctgccttgttggacttccggctcaggagagcgacctgtgctgcttggcgttggcattttattttattttatttattttatttattttgagatggagtctcactctgtctcccaggctggagtgcagtggtgtgatctctgctcactgcaacctccgcctctgggattcaagtgattctcctgcctcagcctcctaagtagctgggagtacaggcgcacgccaccatgcccagctaattttctttttttgcatttttagtagagatggggtttcgccatgttggtcaggctggtctcgaactcctaacctcaagtgatctgcctgtctcggtctcccaaaatgctgggattataggcgagagccactgcggctggctggcattggctttttagacataagccattcaaaagctccgtttagggacagaagatgtctcatcgattaggccagtagtaacattgggcacttaatatgtgccaggaaccatggtaaaggctccacgggcgctatctcatttaatcctctgaaaaaccatgggaggccaggcatgatggctcactcctagaatcccggtacttcgggaggctgaagcgggagaatcgcttgcatccaggagtttgagacgagcctaggcaacataatgagaccccatctctacaaaaaaattaaaaattagctgggtgtggtggctcgtgcctgtagttccagctacttgggaggctgaggtaggaggatcacttgagcccaggagttgaggctgcagtgaaccgtgattttgccactgcactcagcctgggcaacagagtgagaccctctcccccaaaaaacaaaaacccacaggaaagggtgctccttttccctccatctgacaggaagaccaaggtttggaaaggccacgtgccctcaccaaggtgacagggcctgcatgtggcagagcagggctgggcatccagagccctgtccccagctcctgagctcttctgctgcctcactgtaggctctggcccgtccagggacctgggccttcacctcacctcacattttccccacttttctgtcccagataacaggcccctggcgcagcctatggattcgatttgggtatgacccccgaaaaaacccagatgccaagatttatcaagtcctcgatttccgaatccgttgtggaatgaaacacggtaaaaattcctgaaagctttgcttcctgcctttctctctctttatctttcagtttctagcattctcttttgtagtaagaatcttttcatttggaaagaataaaaaaaccttttgcccccgttgctgagactcttttgaatgcagaatggcgtggaaacgaaagtcctagttctgtgctggccccaccactgaccgcccgtttctgaaccacagtccctcattaagtgactccacgtgccctatggtcctgtgatgcaggccaggcacttgtgagagcatcagtgcccgccctgcctgggaagtgctgagatgtgttggtgaccgcagtggcgtgcttggcagtctggggttgccctctcaggagctggccccatggacccaactcccatctccagtgtgaagccagtgttgtgtgccgacgggccctgtgcccgcccacctgacttgcccgccctcgcctacaggttacgcccccagtgacttgccggtcaaagcaaagcgcagcacctacaactacagcctccccatcaccgtcaagaagacatgtaagcgtgccaggcgccttttgtgggtcatgagtgatttgccaaggaaggcggggcacctggacccagacggggaggtggttcctgggggtcactccagggctctgccggtcattcctcccctaggagggggtgggctggcaggagggcagggcatggtggttgggagagacacctcctccccaccctgcacattccaagcactgctgttgtccccacgcagccagccagcttgtcaccatgcatgacctgaagcagggcctgggcccgtcggggacgagtggtgctcggaaaccagcttccagcaagtacaagctcaaggtgggcgcccctggaggccaggaatggaggggaggacttccctcttggggccgggcaccttgtgggtgacacctggggggctgtgattagggcagctctgcccaccggggcctcggcaccttgcttccttttaggtcagccttcagacactgagggtgagaactcgggtgcaaagccccagggctgtgtgtgttggggacatctggcgaagaggtggtgacaagtctcagggaagtctggcaccagcagctgcatgtggttgtccttctcgagccctttgggagcctgggcccccactgagccacgtgaccactccgggaatgatcggaattgggcacacacaggaggacagagccagagcaggccatgtgggctgcagctgtggcaggagcctcactggctcacgtttccgtcagtgcggttgcccagcgggggttggcggtttccagagctgttcccacattcaggctcccgcaagccgctccacagccctgggggaggccgagaagggggcatcccgcacggtggaatcacctgctgagggagtgggtggcagagatgagtgcagcagagacgggtgatgcgagggacttgctgtcccccagtgtctggggccctgcctattttctaggttttttagacctttgctgccttcccagtgaggggcgatcatgccacagcctgtgcggccttccttctcgaggcctctcctaggaggccgttatccttactctagaactacatggctgggtacggaaaggagagagcaaacactcactaagccctgcttttcccagaaaagatgtcagggcagcccatagggggacatagggtgacaaattagcagcagtgggtgagggataaggtcagagtgcaggagggcacagagagcagagcccggcacaaggctagtgccagccccatgccatgggcgccatggcctgctgcacgggcgggctcaccgtttccagtggccccaggagggcctgggtgctcctctgcctctcccagagcctcctggggagttggacattgttttttccccaactcctccgtggccttccagcctgtctgcccaacctgctcctggtgaccagccagctccctggagagaccccatgggagcctacatggagtctgcaacactggcagccccagggctctggctcaccttccctgtctctctccccctttgtcaccaggactctgtctacatcttccgggaaggggccttgccaccctatcggcagatgttctaccagttatgcgacttgaatgtggaagagtacgtatgggaggggccctgagacactgaggggggcccgtgggacccagggaccaaagcggtctctgaactcttccacttcacgtcggccttcatctccggcaagagcactcgcctgtctgggagtttggtgctgccgagagccctggcatgctggtggccctcgtagaggcggtgccctatagaaagccgtggctccaagctgcgcagagacagttcttactgttatgtccttgctcctcttccactgtccacataaaggccccatgaggtggttctcaatcccaggacccatcagatcccagaaaccttttatcgacttgttctcagtgatgtttaaagaattgcagggaaagggcactcactgggatgagaggagatgggaacacatcaaatacatcttgaactctgctgaaagccatggttcaccagaagcatgtgcagtggtaacacggccagcttcatgtgtgtgaggcggtccagggagcacacaggtttagggccccagctgggaacacacagcttgtgtttccagttcctctctgtagacttcgctcacggggctgcctttgatctcagtacagctctgcctctggcaaaaaccaacactggcatctcttagcagagacccgccctgggactttatgtcccaaccctctccccacccccaggttgcagaagatcattcaccgcaatgacggggcagagaattcctgcacagaacgggatgggtggtgcctccccaagaccagcgacgagctcagggacaccatgtccctcatgatccggcagaccatccgctccaagaggcctggtaagagccgcttggggtaaagggggtccaggatgcctggtgatctcctttgagacagaggtgtccctaaggggacccattcctgggaaatggcacccaggtggcatcatcttgcccctggccctggtgggaggaggacattgtgagccagagcccagcccaggtgctggcatcaccccagctgcccagaggctgcctcagccgaggccctcagccctgcggtccggggcaggagacaagcccagaggggctgggtgcagcagcctggcactgccatcggggcctccacctgacgccctcacaccagcccatgtctttcagctgtgcatgcgcaggctctgcctctgtcttcttcctgttctgtgtggcccagccccttcctggaaccaggcagccctggcaggagtgagggccagctgcagggaaagtgaagggggcaacacctgccaggctgtgggtctcacgaggctcgggggagttataagaggccccctctctcagggaactcctcccaggcttggggaggaggcatcctggacccagccacgccccacagatctgaccgaagcaggggttcttggtcttgcttggaacccagattcagccccctttgggaatctaatcaagggtgtggaccctttcccagagaaaatggtgtgttcactcctgagggtccatgggcccttgaagctgctcatggctcccctgctgcaggattcccctgggtgcccgtcaaactacagcttccctggggggcctccaccccatacttacccaccagcttcttaagagctcgagctcggacccttatagtagtaaacaggctccccagagcctggtggcctttctggggccacccggcagcctgcatgggacacccatggccttgtctcctccggccccagctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaagt

SEQ ID NO: 14904 - DNA, 153 bp, Homo sapiens
tttgtaggaattactctttattccaatattataataatcctcgctctataatcataacctaagaaaaaccaggtcatacagagataggagctgaggggacatggtgagaagtgaccagaagacaagagtgcgagccttctgttatgcccagac

SEQ ID NO: 14905 - DNA, 118 bp, Homo sapiens
aaagtatgaggctgggcacggtggctcatgcctgtaatcccagcactttgggaggctgaggcgggcagatcacttgagctcaggagtttgagaccagcctggccaacatggtgaaacc

SEQ ID NO: 14906 - DNA, 5266 bp, Homo sapiens
tgttaatacactggtcccatcagtttcgcatcgtactaggtgctcggtcaagatcatgataaaccgctggaaagggagaagaagttaaggtagtactacagacagaatcttatactttggaaaaaaattcatgacaaagaaaccccaaagtattgcctgttccaccctgtctttgtggtgtgtgtgcctagcttccattattcatgaagtcaacctagaagggcagactggtaataacatgagttggtacattcttcctggcaatacataaagacctttaatgtcttaaattacttatcctagtaatattacttcctggaatctattctaacgaagtaatcagaaattttaacaggaatctatgcattaaaatgttcatggaaggaaaatgatcagcaatgaggaataattaaacgagacatatataaaaaaagcaacccacaattttttttcaagcatggagaaatgctcatgcgagaatactaagtaaacagcagagaaactcagacatacatggttgcctctgagtagtgaacttttatttccttcctaaatttttgtatttttaatctcttctataaatgaatgtgtattccttttacaatgaaaaataacatttttaaaaactaaaactaaagaaatgtattgtttccttttatgtataaatgtcccaagccaagatacctgaaatataacgaggaaaagattcttttgttcactctgagcagattccactttttcctgaagtcgttctatttgttcctcaagaaccccgtctttcctgtcactgcttctgtcgtcatcatcacttcgctatagaaggcaaatgatcaaaaggaaaataccatttagattccagtgtgttaaatctcctccaggggaagcattttactgtgtctggccaaatgttaagacttatattctatagtgaaagtacccccccaccccgccacccacacatatatacctcaaagtcctgttgtggttcagagacactgtcttctcattcagaaattccatgggttcttatctaggccagggaaatttagtggcacttgtcttggtaacaacatggggggacttggctacaatttatcactatttgaccatttgagcagtaacaacagggagacagcttgctaatcattcatctgctaatgggccatacagaaaaactgggcaagtcctatgggccaaggctgctcattcttgttataatttagaaatggctccagccgacatataataattcaaagtgggctgtttaagactttctgctggcaatgatgggctcaatatactcctgtaaagctttaataatccctgcccccagctcactctgaagagtttatagaatttaattttttctttttaaaggaaaagaaaaacaaggcatggtttatttccattttacagagaaaaaaggctgagaggttagatgactttcccagcatcacccagtcagaaagtggcagagccagaacgtggctctaaggtgttacataccaaggtactttcagcaagaaggtggcatcactgaatctagaaagcctggtaattcttcgaggttaatacttaactgctaaggccccatctactgatctctccactttaagcaaaattatcagaaccctgctctcggatatcacagaatcttgcttttctctctataaacacagcccatttatgaggtctgctctatgttctagacacgtgggtacacgactgtcctttcctaacaccactcaaaggtaaggttctagagcactactacctaatagatagacctttcttcaatgggtacaatgttatctaaatatgtgcagcctgttacgacagcaaccacacgttactactgagcacctgaaatatggttgtgtgaccaaagaacctgatgttaaattgtatttaactaaaatagtcacgtgcagctagtggctactgtgttggacagcacacttctagaaacagtgtggcatgaaaaaaagtctctggagtctgacagacctgtgtcagaacctagctctggtcatttaccagctatgcaacctactagctatgttacttaacttctctatgtctcactttataacatctacaaaatgagatgacaccatttaccttacagtatttcaggtctgagtgtttatatccatatatgtttacaggtatgtcaacatggagactggtactcaaacttgcgaaaggttcctatagggcactaaactcaactttttttcaccttctactatggtaaatatgcatagcactgaaaatactttcataatgaatagtagtatcatgttaagtcactcactgcttccctccaaaatggctaaaatactaaattaatactatgagaagtattccgttaacttgggaatgactgccccattcctcctcacagtacggggaaagtgttaagtatctatagtcctctccctcttcccccagagactcctacagaaatacaagtgtcctcttcccttctgctacttcccttgtgcaaacgtgaggccgacccagagatagtgaactatgggaagtgaagtttgtggcttcctgaactggttcatcatgcagtgtaacagcacacaacacactacctgctccttcctcctcttctgcttctgcattaaattgggctcagaaaaatttctgctctgcattaatttgggctcagaaaaaatgaaatatcatcaagataatgaactctgaatcctctccagagtttctggtatattttctttaactacttacaagtttacacaaaacttacccgtttgtgttgcctagcaagtttctctttagcttcttccagctctttctggatcttcaggacatgtttgttcatcttacgaattgtagagtgcaaaatttcccaaacaaacaatcttaaagaaatatggcatttggttactgtatgtcaagctatggttacagaaaataaaatctttcaacttttgtaatttcattcttaacagctgatacagccttctgtccttggggctgaattagtcatctttctccagcaatacttacaaattggtcttttattgtaaattgtgcaagtatctatcttcacacccattagattcaggcgagccccctgagggcagcactgtgtagtcatttttcttatttccatcccttaccagaggtacatacttactgaattgaaatggcaaactatgatggacattaacattaaaaatggaaatacatttttcctctcctaaatgtaaacattatgtgtagaaattttctcaaaatggtgacctaacctgagacttatttcccatgctttatattatttaactagcacacactcagccaattattctcttggaatgtttaagaaactcattagttgataataggtatcaactgatgggctctaagaatgagataattatatgtcagctttcttactagcaaatacatactaagatcactttgtaggtgctttgaaatgtttgttgcataagtgtttttcttttaaaaagtaacttctcagctacttttgtgtctataaactaggtctcctaacccagcacagaatagtacagttggcccttgaacaatacaggtttgaactgtgcaggtccatttacacatgggttttcttccacctgagtcaataagaccaacccctcctcttcctcagcctactcaatgtgaagataatgaagatgacctttatgatgatccactctcacttcatgaatgtttcctctcttatgatttattgtaagaatacaggatataacacatacaacacaaatatgtgttaattgactacgttatcactaaggcttctggtcaacagtaggctactagttaaattttccatgcagttaaaagttctatgcagatttttgactgtgtggggtggggtgggtggggcgaagtcggtgtctctaacccctgttgttgttcaagggtgaactgtacttccttctacaaattttgacccaaataatagtttaagtggaagataataaaacaatctgttcataaaactccaagtctagaatgttaggaaacaggacaaaagagcagagcactttaactctggagggggtggactatagtcagggaaaggtttgcagagttacaaatatttgagctaggtgttaaagaacagatggagctgttgagcactatacagattccagaatgcctgggtttgaatgctggctctgcacttagttgtgtgactttgggcaggataaagcactctgtgacacttccctattctgtaaaatgtggacaataatggaaccttctctacggtgatgcggtaaggataaaatgaattgaaaacgtaaatcactcaggacaatggttaaaacatactcgggtggttagttttctgagagtttacaaatctgaaaaggttcttctgttgtctttgtttatgaaggccaacctggccggtatgacaaccttagatcacaccctatcaccctaacaattcagtatatttctgatcagtgtcctctggcagtaacagatacagtggaaaagttaaaggttgtgatggacttttatgtttttacaagtaatttgctttagtttcctgctttgtgtcaactcctgctgccctggtcctatcagctgtaaagtccgtgaacttcataaataagaaccaaacagcaaaaactttctttccgttagggggaatgagggcagaatgaatcttctgcattaaacctaagattatgactgtggtgagaacccctttcccccatccctcaggtgtcttgttaatcaccaagctttcctggatccctccatgatttactctactttgactttgatttctcctacttcctggtgtgcattctaggtgccatccccactgaagctggaacccttcccgagttccatctggactagctgagactctgcacatagctggctcttgctagttttctctcccaacagtctggatccttcaacaggatttctacttcactggcttagccttgattcaacttaagagtgtccctgctaagagacgctgcaacctgataggctgtgtatgtttccactgtctaggaatttttgccatgtccaatcctaccagattggaccattagtatattaatatcaacctggtttggaccagaatttgaagcttatgtataagagaccacacatatatcaattcttagggaacacaagtttcataaaataatttatattacctggtaaagtcacgagatagttctgaagagaagatccaatttgctacggcagc

SEQ ID NO: 14907 - DNA, 884 bp, Homo sapiens
ttcagggactggatggagagaagggaaaggcatccatttattcaggtattatttttttccctttttaatgatgaaggaagttgagaccaggagagggaagtaacttattccaagttacgaataagtcacaaaactgggagtaaaagctgggtctcccaatatcctccttcaattctgtctggtctttactttctttaaaaaactcttcactgcttattgcaagagccagagactccttttattgtgaatgccagaagggctctccagtcgtccggaccaacctccatctgctgcttgaactcctctgccacttcttgccaaatttgaacatttccatcatgtttttggaaagcactttctattcatttaaatattcggcagcatgtactgagtgctgtgtgccaagcacaagaatcagaagtaaagacacagtataacaggaaccaagatatacaatgtttgagaactactgtttgagaaatatgaagtattagagatgccctggcagctctctgaggtatgagaggcataaagaatgaagtggtcagaccttcccaggtggcaactaacaggtcagctgaattttaaacaacaaaaaggtagaggatgggaaggtggggggcattgggagtaaagaccctctaagggtaagcttttccttggtcacttgggggcactcaggctacctggaatggtagtaacatggcaaagggatggcttgttggagatgtcaagagacgacctcctgatgggaccatctcccaatgtggagcacccaggcactggagccacattgccaattcaaatcccggtcctgcccacggattgtgggtaatgttaattacctacttccctagacttctgtttccttcttgtaaagtgtg

SEQ ID NO: 14908 - DNA, 250 bp, Homo sapiens; identical to SEQ ID NO: 10183

SEQ ID NO: 14909 - DNA, 326 bp, Homo sapiens; identical to SEQ ID NO: 10184

SEQ ID NO: 14910 - DNA, 321 bp, Homo sapiens; identical to SEQ ID NO: 10185

SEQ ID NO: 14911 - DNA, 318 bp, Homo sapiens; identical to SEQ ID NO: 6723

SEQ ID NO: 14912 - DNA, 270 bp, Homo sapiens; identical to SEQ ID NO: 10187

SEQ ID NO: 14913 - DNA, 248 bp, Homo sapiens; identical to SEQ ID NO: 10188

SEQ ID NO: 14914 - DNA, 284 bp, Homo sapiens; identical to SEQ ID NO: 10189

SEQ ID NO: 14915 - DNA, 33 bp, Homo sapiens; identical to SEQ ID NO: 13399

SEQ ID NO: 14916 - DNA, 1836 bp, Homo sapiens
catttgtccatatctataagactttacttctgggttctctattctgttctgtttatttatatgtctgtctttaggacagtactacacagttttgattcccctgttgtaggggaatcttgttttattgtgcttcactttattacgctttgcagataatgcattgtttacaaatggaaggtttgtggtaaccttgcatcaagcaagtctattggcaccatttttccaatagcatatgctcactttgtgttcttatgccataatttggtaattcttgcaatgttttcagtttttttcctcctcctcctccttttccttccttttatcctcctcctcctccttcctccttcctcctccgtcctcctcctcttcctcttcctcttcctcctcctcttctccttctcctccttcttttccttcttcttctttctgggacagggtctcattcttctgcccaggttggagtataccggcacgatcatagcccgctgtagactcaaactcctgacctcaagcaatcctcccttcttggcctcccaaagtgctgggattagaggcatgagccactgcacctggccagtttttcattattcttatatatgttatgggaatgtgactagtgatctttgaagatactattgtaactgttttgggggcaccataagccatacccatgtaagacttgaactgtgtattccagtgaaaggaagagctgcatgtctgtcactttaaattaaaagctagaaatgattaagtgctgtgaggaaagcatgtcaaaagctgggtgagttaggtcaaaagttaggcctcttgtaccaagtagttagccagcttgtgagtgtgaaggaaaatttcttgcaggaaactaaatgtgctccttcagtgaacagtcgaatgttaagaaagcgacacagggttattgctaatatggagaaagtttagtggtctgggtagatcaaaccagccacaattttcccttgagccaaagcctaatccagagcaaggccctaaatctcttcaattctttgaaggctgagaggagtgaggaaactgcagaagaaatgtttgaagctagcagaggttgtttcatgatatttgaagaaagaagctaccattataatatgaaagtgcaaggtgaagcagcaagtgctgacgtagaagctgcagcaagttatccagaagctctagctaagatcattgagaaaggtggctacactaaacaacagattttcaatgtaaaccaaacagctttctaatggtgaagataccatccaggatgaggagtcaatgcctagcttcaaatcttcaaaggacaggatggctttcttgttaagggccactgctcatttaccattctgaaaatcctaggttccttaagaattatgctaattttactctgcttgtagtgtagaagtggaagagcaaagcttggatgacagcacatctgtttactgcatggcttactgaatagtttaaacccactgttgagccctactgctcagaaaaaaaagactcctttaaaaatattactgctctggctcacgcctgtaatcccagcactttgggaggccgaggcgggtggatcatgaggtcaggagatcgagaccatcctggctaacaaggtgaaaccccatctctactaaaaatacaaaaaattagccgggcgcggtggcgggcgcctgtagtcccagctactcgggaggctgaggcaggagaatggcgtgaacctgggaagcggagctttcagtgagccgagattgcgccactgcggtccgcagtccggcctgggcgacagagcaagactccgtctcaaaaaaaaaaaaaaaaaaaaaaatatta

SEQ ID NO: 14917 - DNA, 296 bp, Homo sapiens; identical to SEQ ID NO: 6750

SEQ ID NO: 14918 - DNA, 295 bp, Homo sapiens; identical to SEQ ID NO: 10192

SEQ ID NO: 14919 - DNA, 433 bp, Homo sapiens
tttttaattttttttttttttttttttttggtagagactgggtcttactttatttcccaggctagtctcgaactcctgtcttcaagggatcctcccatcctgacctcccaaagtgttgggattacacatgtgagccactggacctggtcccctttcataattgaatatgaatgtttaacaaatagatttgctgctcgggctgatttaaatctaatacggttaaagatgtatgactaaaatacaaggttgttaaataatactttgtatataggtaatatattcctgtgtactaattgtttttattgtggcaaaaaaacttttacacataacataaaactcaccctccaatagtttccaaatgtacagtatacttttgccaaccacatgcatgttgttatgaaacagttccccagaactccttccacccaccctg

SEQ ID NO: 14920 - DNA, 9951 bp, Homo sapiens
agttccgagactactgtgctatctgcttaagatgggagtggcctgggtctccaaaagcattggaaaagtgcaatttagaagctgctttctttgaaggtcattttttgaaagtgctgttcgacagaatgggaagaattcttgatcaggtaatacattttaaaatactaattttcatatttttttttgccattcaccacagaatcatctcaagtcttagtagatcttcaataaagtacttttattgttttcttactttttccactggatgactttttcatgaagcttgattgccaacaactggcagatttctgatgcattctgtatgttaaaaacatttatttggcctgacagctgcttgtttattttacttctcatgataggccattgtcttaatatccttaacacattttggagatgattaggactgcttttcttttatgacttgcttagccttttagttagtacatttagtacaaatacagatgctcaatttggaagaccttaaatgtcatttcagattgaatcttgaacactggtctcagtaaaatcacagaatagtgttagatgaacctggctctttagacaaagcttgtaaacgatactcattttcataagggagaggtgaaatagaaaaggttaatgtactcctttaaaggtggataaaaatcaccatcagctgataagttgctatgtacatctcatctgactgttaggagaaataaatttgggattatggaatccctccttccatctctcattggctcataagcttagtgatgagagagctttgaaatgcttgactcattagaatctaaacctgaaagaacacaactagcatagtactttcctcagtgtggaaactgagtggaccaatttggaattaattttcaactgtatgttaaagtacgtgttctttttttagcattttagttaaatatttatgtgagcatagggagttgtaaaagaaatttactaagtaggctgtcttcagtaactagaaagtcaaataaagaaattgtaatctaagaagtatttcactatgttagagtttagtcagcgttgtttctgacggtaatctctataagagaccaggtccttttttttttcttttttaacctcttaatagcattcgctgtatttctagtgttgcttggttggtcgttttaaacctgacaaccaaagtataaaaatctggctattaataggtattgtggcctcacctcatggctgtgtaaacctcctgggtagccaggatgcatcagtttattgtggtttgttttttgtttttgtttttgagccagtttgctaggcgtagtttaaatcaagcttgttgcttgattaagctaacaagcaagaggtaataacaatgagtatcaagacagtaatgtttaggaattttgaccgaaagtactaaaaaggaatctaaattttaaaaagtagtttctgaattgaaagatctaccctgaatcttcaaccttgagcactttttctctagtttgtggagtgctggcacaaaaggatacattgaaaacagaatatctgaaatacttaaaatacttttcaatttcaccagatagcacttcatagcacagcgctgattcatagactgtttcagtcattcttcctgtaaccgtgtatcataggcaagagagatttctagtattattttacaaatgaggaatctttggtttcagttatgtgacttacagctggtaagctatggagccccgtctgaaaccttttatctttaaaactcttgagccgggtgcaactgtagtcccagctactcaggagtctgaggcaggaggattgcttgaccccaggagttcaaggctgtagggcgctatgattgtgcctaaggatagccactgcacactagcctaggcaacatagtgagaccccgtctctaaaacaaaattaaaacacaaacaaaaaaaaaacccttgattttcaaagccttttgggtaagaacgtggtatagtctgatctcagagataaaacacaagtcctagaaagctaagcatttttggcctagttttactttctttcctaaacatttttgccggaagtgatacttgcttgtagtttcttttttttctttctctccctatttcttcttcttttttttttttctgagaccgagtctcgctctgtcacccaggctggaatgcagtggtgtgatcttggctcattgcaacctctccctcccggctcaagcgattctcccgtctcagcgtcctgagtagctgggatcacaggtgcacaccaccacgcctggcaaatttttgtatttttaatagagatggggtttcaccatattgctcaggctggtcttgaactcctgacctcaggtgatccacctgcctcggcctcccaaagtcctgggattacaggcatgaaccaccacgcctggccttcttctttcttcttttttctttttcttttgtttttctctttgcagggcattttcttagtatagattcctaatagggtctaggtaacttgactgagattaaaaatttaatatgaatagtttggcaagtggctaatgtcttcatgcataattgagaacttacagtatcaagtattcataacactattgtgttatcacaatgctaatttgaaaaaattcataatacaaacatttactattgtttgtaacggtggtgattttaaaaagatagtaaaatactaaagcccatagcagaatgtaaagaacactgggaacattgtaaggaggccaaatcttgtccctgccctgagcatgatgagtttgaatttgatcaagtaacttagctacttgtcacattttctaattgttaaagtgaagttgatattacttttttaagtcaaagtttattatctcaaaatttgagttcagtccaaaaacatgggccaagtccatttgtcatgtcagagaaatctggcttgctttcctttcaggtaaatactgtataaagtataaaataaagggacctcaagtaatagatataaacacttaactaccaacaacttccaaaaaggctagcttgttttaaagttattaccaataggaagtagagaccatttcagagtacagtgaaacaagtttatcttgttgaaatttattttcatttttactacgttgagaaataatctgtgtcagccttaaatttcttaagcaacctatgacctacatttatgttaaaataaactacaaaccaaggtaacaccacacagagaaaatacaaagtctaaatagtaatgtatttgtttaaagccaaattgtactgatttatttatttaagcacctgcagatggcgaaatttagtgacctaaaaatcttaactacctgcagtgaagagtcatgtacaattctggacttaagttgtattttaaattttttctactttttttttttttttactaaatgcattcttttaaattattttttgtaaatgattccttcatacctaaaatacaatttaatgtgaattcattgtttattatgagttgagtctcagagaaggctattctgttgcaaatattatcaagggaggaggaatggagagaagttggttaatgagtccaaaagtacagttagaagaaataagttctagtattcagtagtacagtagggaaattagttaacaaaaacgtattgtatatttcaaaggagctagaagagaactgtgatgttcccaacacgaagaaaagataaatgctggaggtgatggatgtcccagttaccctaatttggtcattacacattacacattgtgaaatgtatcaaaatatcacatggaccccccccaaaataggtacaattatgctatatcaataaaaaatacccaaagcccccaagtattaccaagtaggagaatttactcttaaactatcctttactgggaatacatatttcctttcaattaccttgcttacagctaggttttgaaaaaaaataataaatgacttggagcagtttttaattctttaaaaaaatccatgttcatgaatctagtagtaagttagaaagactaaaatgggccttacagcataggacttgagagtttctgtttatgtaacaaaacatgttcatcgtagcgtctgtagctgtggtgattttcaaaagatagtaaaatgccgaagtctgtagcagaactggcgtgtgcccgagcattctccactgaatgccagagattgacttcctcattgctattcactgtgatcaaggctttgcaggttgttcagtggctgagagtgaaacattccgctgtgctggctgatgttgcacttggtcctgactccctcttccctccactgtgctgcagtgtctgtctcactcttgccacctgggttctctgcagcctcctcactgtagttagttttgttgcaaccaatccgtttcctttggctgcttagaagaagcaaactggaaggggtgagaagtttctattgaaagttctgagcaagtagtagcaactccttgtgtagtgtgccttttgctttgttgacatgactctgtaaagcccctttctgtgaagaataaacagacaattagaattcaagtaaaatcacgatattacatgtaaaacaagtgtgaggaactgtacacagatatacagttgtttggagaaagttaatactcatgcaagaaatgagatgatccctctctgtaatcaccattttgaaccttctcatccactttgaggcatagggtcgtcatcagttctatccccaagtactttcatttcattctggtgacaaggttctgtgattcgactttattttactgtatgtgtttttgggaattggcagtagttgaataatctgaggtgaggaatatcacttctaaaattactatatttaaaaaggtgtaatatcttcccatcttgttttttggtcttatgctcaatgggtcctctgtaattaatattatatatgacacactggtgcttttttatgaccccttgaacaatttcattaattgaatcaacctgcataaaataaacattctgactctgtcacatatttgtctttatatgtttatatattttttaaatctttaaagttttaggcctgcaatatatgtaatttgagatgatgagagctagtttagttgtagatattttcattgcagaagagcatgcgcagcagggaggaagatggtggattctgctttctttttttttgtttgagacagagtttcgctcttgttgcccaggctggagtgcagtggcgtgatctcggcccactgcaacctccacctcctgggttcaagcagttctcttgcctcagcctcccaagtagctgggattacaggcatgtgccaccacaccgggctaattttgtattttgagtagagacggggtttctccatgttggtcaggctggtctcgaactcccaacctcaggtgatccgcccgcctcagcctcccaaagtactgggattacaggtgtgagccactgggcctggccagattctcctttcttaaaagaacaaattgaaatagtaaattaagcacaccggtatacattatttttaaatgtctttctgttttttatctctccatagccatatgatgtaaacttacaagtaacctcagtgttatctagactttctctcttccctcatccacacatccacgagtaccttttggatccttacgtgaacctcgctcctggctgtagatctctcttctctgtaattgtcagggtgagttactagttctgttatattccctaggattgataaatctgtgcaattaatatgttaatatcattgtatgcagttagtgtcacataatgaaaaatatatctactgcttaaaagtaattattatacattctgaactactattttttcaattattttaaataatatgtaacttttattttaaagaattaggtatgagtccttggttaaagatgattatatgagtagtgaaagtttacgttctttattaaatagtagggaaggaagatttttctttttagatcctgaggttgtctgtgtagctgatttcaggaactgaagtgccttgcctctgtgatgcaggttgttggagaccttatgcttcgaatccagcgtattcaagactttactcccaagcttctgttagtcagaaagcggttacttggtttggaacctgaaggccctatgtaagttagtgttttacatttttttaatccaaaaatttcagtgaacttaatgatcggctgctatcttgaattgatttattgtctgttttttccttaccagtattgaccacatcacactgctagagggtgtgattgtgttagaagagttctgtaaggagctggcggcaatcgcatttgtaaaatatcatgcttcctccacaccataaataacatctttcatgtaactgggggaacagaactactgtgtacatttcaccaaaaaagactcagttccacccagccacaagaggataaaaagcctttttaaacgcagtattgctgtaaactggacagaaccattaagaacctattgagtggacattcttggtgaaatgttgtataatgttgttttcattggctttatcataatggttctatatatacaattgcacattgttgaatccaggatacaatcaaaggaacttcaggaaataagcatttctaatgactgtgaaaagctgcaatatttccaatgtcatgactttgatgatatttctgttatattaatgtccttttaggtagcaaggcattttgacattctctgggactcaaatgcttgtattcttttggattaataagtagcaaaaaaaaatcactaattttataactttttaaggtcagaattcttatcaaacaaaatatgaaaactgtaaatgagaaaaaaatacaattcagaaaccattgaatgaattaattataggcgataaaaatgtgtagagcaccattaactttcttcagcttttttaagaataacaatttaatatgataaattcttgattaatataatatatctatatttttaaagaaatgttcttttactcttttgtgcacatagccatgttagtgattttcttcatgtgtgggtcccagtttatttaaactgtgtcgttttcgcagcagtgttcaatttgctcaccattggtagtgtttgctaaaattgtatttttttaagctaagtaacatgtactgggttgagaacctttttcccccctctccctctcagaaaattgctttataaaattgctttataatttgattttcttactgaaacgcatggtggtgtctaggtggggaactgactgataacccttggcagcaatcaaagtgccagtggctcctcgatgtttacatttttttctattttgttcagtcttttgttttaaatgattctaaagagattaaagaaaacagagttttaaatgtcctatttacatgttaaaggatttggggaaattgggtatgtatgtgaatgggtgtacatgtaggaacctgtagttcagcaaagctgcgctgggcacagcatgcttgtacttgattgacaaaatcgtgtttgccagtccactttctatttttcctttaagtgatgctgatcactcaaataatgcttttaagctattgtttgtttttatttgacatgttaagccgcagcactttcttcttcatctttccatttactgatatttgggggaacaggctatcaaaggttccggcttgaagggaactgtcactaccccctctaggaagttattttatgtagcatgtttgcatatacgcattgtgtggcatgtgcatagaggcttgttttacacctatctgctcattttgttgtgttagcttttctggtttatttcatagtttgttcttgctatttattaagaacagaatatcaaaagattatgaatagcctcagctctagaatgcttaccactgttaaaacaacaaaaagactaaacctctaatttcatgcaaatctttgttagcttattctaagaaatttattaagtaaaacaaagaaaaaacagaagtgggagatagttattttgtgcgtaattttctttaaatcattttgaatgatgtgaaggcattcagtttgctgtatttttttaatcacttcatacaaggaaaacttcgacatttacatttctagatgtagtaacagtctactttgatatatgagtatttaaactaaggcattaagagatattagatatttcttaatgttttcatagtgctcaataggtgtagtagcaatgatattacctctgaaaccaaatactcttttatccttgattccactatgggaccttataactagtccatgaaaccaagctcagaaaagctttaactcttatatttgtgtatatgtatgctgcttctgaaaatataatttttctaagttgttgtaatgactttaatttgtaatcagctaaggcttaagatttcatttgtttctaagtttctgtttttcatcccttcttttttcttttatatttagttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaatatagtctttggatttgtttttagttatgagccgcattctttacttgatagaactcagatttgtcttagcctattgccatatagtactcaccttataactatgtaactttctcgtaatgtatctgtttgtgcaatatggaagctgtgagtggattcatagctttttggtttaattgtacattattgtgtgtgtatatatgtatatatgtatatatataaggaccaaaattcttagctcgcttacactgttgctagtgtaaacattgttacacttaattttacagggcacaaattatggaattacttcataaattcatggtaatgttttcataaattattgcattaacatacaattgccatttaattatgaagtccatcagtattgacagaagacgttacagtgaagtgctaaaaccacactatatggtaattatattttgggttatgtagtaaatcaaatatgcatgtcattgtgacactttatgtgttaaaacatggtagataatcacattttctgggccctgtaaaatagtgttactgtaatactctgttttgcctcctgccttgtttacattaaacaggatatttggtaaatttttttgtattgaaagttgtgtaggttactgacagtgttaccagcgtctggaattcttggtccctccgtggagaaactcttcagatggtcattgtgtacctactctctcttcaaaggaagttgtgatcaagttcaactttttgtgctaacaatgcatgcaggactaagagggatgatctaaaaaataaataatgtaatttaaacaaaacgtcttatgtttttgtaaaattctaattgggaacattttatccaatgataaatctcaaacaatttttaactttttgcacccccagcacacaaagggatatggcaccctacaatcagtgggtctctatagtattctagggagagaacaaaaagcaatgtatctatttgtggaggagagatgtgtagcttgaaaaattcccccaggaaaacctccacttcccttcttaataatcactgcccaaaaggaaggaatgtttatgcacgtctcaaaaacaatttttttttttttgaggcagagtctcgctctgttccccaggctggaatgcaatggcatgatctcagctcactgcaacctccgccccctgggttcaagtgattctcctgccccagcctcctgagtagctgggattacaggtgcctgccaccatg

SEQ ID NO: 14921 - DNA, 9951 bp, Homo sapiens; identical to SEQ ID NO: 14920

SEQ ID NO: 14922 - DNA, 102 bp, Homo sapiens; identical to SEQ ID NO: 6331

SEQ ID NO: 14923 - DNA, 147 bp, Homo sapiens; identical to SEQ ID NO: 6794

SEQ ID NO: 14924 - DNA, 4678 bp, Homo sapiens
ctctggaaatccttgtaatcttgaaggaatggacctcaaagtaaagagtcttctcccactaccttttacatacacctcatttactcatttaaaaaatcctcagtaatctcttactttctgccctctactccatcaaaatggattaattacctttagaatattaccataggaacatatttattctcctttctttaggttgaagaaaaatagattagggaaagacattgctatttgctgtttgcttactggattatcacagttgtccactgttttttcatgttgaatctgcagtggagaacactgaaaaatacgatttttattttctctcctgattttaccattgggagaaatcaggtctgtgtaatttagatacactgattctttagcagggcaaggttcagcatatgtggcagttttactgatagtttgagccaatgaaaaagaactctgccatggaaatgtgttgtctttaaatttagtacttgtaagccctgtttcaagtaccataaagaacaagttgaacttttacatgccttatcttctggcatgcccttccaagttattctctgtactattatcttaacatttttattgtactaagagtttataaagtattttgtaacattttcagctgattttgatccttagggcaactccataaagaaggtaaaacaagtacattattataaacattttaggccaggcgtggtggctcacacctataatcccagcactttgggaggtgggtggatcatctgaggtcaggaattcgagacctggccaacatggtgaaaccccgtctctactaaaaatataaaaattagccgggcgtggtggcatgtgcctgtagtcccagctactcaggaggctgaggcaggagaatcgcttgaacgtgggaggcagaggttgcagtgaaccgagatcatgccactgcactccagcctgggcaacagaacgatactctgtctcaaaaaaaaaaaaaattagccggtcgtggtagtgcatgcctgtaatcccagctactcaggaaaatcacttgaacccaggaggtggaattttaggccatttgggaggctgaggtgggtggatcacctgaggtcaggaattcgagaccaccctggccaacatggtgaaaccccatctctactaaaaatacaaaaattagccgggcatggtggcgtgcgcctgtagtcctagcaacttgggaggctgaggcaggagaatagcttgaacccaggaggtggaagttgcagtgagccaagatcatgccactgcactccagcctgggtgacagagcaagaccctgtctctgaaaaaaagaaacaaagcccgggcatggtggctcacggctgtaatcccagcactttgaggggccgaggcaggcagatcactaagacaggagttcaagaccagcccggccaacatagtgaaaccccgtctctactaaaaatacaaaaattagccgggcatggtggcacacacctatagtcctagcaacttgggaggctgaggcaggagaatagcttgaacccgggaggtggagcttgcagtgagctgaggtcgcaccactgcactccagcaacagagtaagactccatctcaaaaaaaaataaaaataagtaaataaagattataaaaacaagaaacagaatcaggttggttaagtgtctggctgaaagtgcaacatgaagggtctctgacccaggtcctctgacttgaaggccagtgctctttctattatactataatgcttctccatattataagttgaggtttaataagatcaggctttgggtaaggaaaaggctacagtgggggttatgataagaacttgggttctctgcctatgtatcttcccttgacccccttctgttactccaagaggccatgatgtgtaaggaaaagagctcagcccagctgagctaggtaacctaactgtttcagcaagaaattgttctgagaatgatgaatgctgaaagtgagactgtgagatatttattttttttatttgtttttaagattatggcatcgtcaaagcattgtggtgtcttttttactgctgcttgctgtgcttatagctacgtattatgttgaaggagtgcatcaacaggtgagaggtcgagcaattctgtttctagtcttgcacattctctaattctctaatctcagtttcaaatgggatgaatgtgggttttatagaatttctaccctcaacattatctcataactagtatctcaaatgttttacttttaaaggcatacactaaaaatattcttgtgatgttttatggctgctgaggatttatatgtggtgtgtgtgattccttttaccttcaaagatttttttttttttaaagacagagtctcgctctgtcacccaggttggagcgcagtggtgtgatctgagctcactgcaacctctgcctcctgggttcaagcaattctcctgctgtagcctcccaagtagctgggattacaggcacctgccaccacacccagctaattttttttgtatttttgtagagatggggttttgccatgttggccaggctggtctcaaactcctgacctcaggtgatctggctgccttggcctccaaaaatgctgggattacaggccactctgcctgtaatcaaagatttaaatgtaactttcctgaaggttttccgtcacagcagcatgaatccgttaatcactgccaaagttttcttattttctctaacatacttttgtgacccatccaaataggtaggcctctcatccaaggttgatgattacgttttatttgtataaaaagacaggttcatttgcctgtagtctacatgtacaacattactgatgggaaaataggatgctttgttaacctcttttgttaaaatagcaaaacattaatgtattttaacaggaaatggttctagaatggtattttaaagcagtttactgccaatcacagaaatgactctagaatggtattttaaaacagtttactgccaatcactgaaatgactctagaatggtattttaaaacagtttactgctaatcacagagaagtttttacagttctaaatgcatttattttaaatatatctaaaattatcctcaaaattatcttattcataatttgctttttcctgtgtcctgtaaatagtaggactttaaaagtttagaaacaaggcttttattaaaggtttagaaataagacctttattccagttagattaatttttttgtcatctttgccattgtgtattaaagaaattaggcctcttcaatgggtttttaatcttattagttttttcctatttgaaacttactttagttgatttaattttgatgatggtttataaataccgcatttctgtatagagaattcacggttttcacctcatccctttttttcagtatgtgcaacgtatagagaaacagtttcttttgtatgcctactggataggcttaggaattttgtcttctgttgggcttggaacagggctgcacacctttctgctttatctggtaagaataattttattttaataagcaaaaatgatatttcctatctttttattggtgcttttatgtcagaagtaaaaattctaagatttgttttaattacctttgtgttttgtaagcattctgatcctccaatcagtgctttaagtttgacttagagttctgttttgtttttcctttagggttagtatttaaaaagcaaagagaaaaccccagttaagcaaataaggttgtttatttaaattagtttagcgtggaaggtttttcttttctttctagatttaattgcttaagcaattgttattttaataaatgaagtccatttaaatatgcaaaattccatgtgagaaatgtcttcccttacatcctctaacatcatttacatacttggatatttattttggtattcttgttgaatgtaattgatggagtattaacatgtagaactaaatgctttcttgagtcctttgaaccaaagtataaaaagtgccccttctgggctgggcgtggtggctcacgcctgtaatcccagcactttgggaggccaaggcgggcagatcatgaggtctggagatcgagaccatcctggctaacatggtgaaaccctgtctctactaaaaatacaaaaaattagccggacgtggtggcgggtgcctgtagtcccacatactcaggatgctgaggcaggagaatggcctgaacccgggaggcggagcttccagtgagtggagatggcgccactgcactccagcctgggcgacagagcaagactctgtctcaaaaaaaaaaaaaaaaaaaaaagtgccccttctgaaaaatattcttttactagtggaaataagagagaatggccaggtgcagtggctcacacctgtaatcccagcactttgggaggccgaggcaggcggatcacaaggtcaggagatcgagaccatcctggctaacatggtgaaaccccgtctctactaaatatacaaaaaaaatcagccgagcttagtggcaggcgcctgtagtcccagctactcgggaggctgaggcaggagagtgatgtgaacctgggaggtggagcttgcagtgagccgagatcacgccactgcactccaacctgggcgacagagcaagactccgtctcaaaaaaaaaaaaagaaaaagaaaaagaaataagag

SEQ ID NO: 14925 - DNA, 280 bp, Homo sapiens; identical to SEQ ID NO: 7656

SEQ ID NO: 14926 - DNA, 190 bp, Homo sapiens; identical to SEQ ID NO: 7674

SEQ ID NO: 14927 - DNA, 2364 bp, Homo sapiens; identical to SEQ ID NO: 6735

SEQ ID NO: 14928 - DNA, 1716 bp, Homo sapiens
cctcatccccttttttcagtatgtgcaacgtatagagaaacagtttcttttgtatgcctactggataggcttaggaattttgtcttctgttgggcttggaacagggctgcacacctttctgctttatctggtaagaataattttattttaataagcaaaaatgatatttcctatctttttattggtgcttttatgtcagaagtaaaaattctaagatttgttttaattacctttgtgttttgtaagcattctgatcctccaatcagtgctttaagtttgacttagagttctgttttgtttttcctttagggttagtatttaaaaagcaaagagaaaaccccagttaagcaaataaggttgtttatttaaattagtttagcgtggaaggtttttcttttctttctagatttaattgcttaagcaattgttattttaataaatgaagtccatttaaatatgcaaaattccatgtgagaaatgtcttcccttacatcctctaacatcatttacatacttggatatttattttggtattcttgttgaatgtaattgatggagtattaacatgtagaactaaacgctttcttgagtcctttgaaccaaagtataaaaagtgccccttctgggctgggcgtggtggctcacgcctgtaatcccagcactttgggaggccaaggcgggcagatcatgaggtctggagatcgagaccatcctggctaacatggtgaaaccctgtctctactaaaaatacaaaaaattagccggacgtggtggcgggtgcctgtagtcccacatactcaggatgctgaggcaggagaatggcctgaacccgggaggcggagcttccagtgagtggagatggcgccactgcactccagcctgggcgacagagcaagactctgtctcaaaaaaaaaaaaaaaaaaaaagtgccccttctgaaaaatattcttttactagtggaaataagagagaatggccaggcgcagtggctcacacctgtaatcccagcactttgggaggccgaggcaggcggatcacaaggtcaggagatcgagaccatcctggctaacatggtgaaaccccgtctctactaaatatacaaaaaaaatcagccgagcttagtggcgggcgcctgtagtcccagctacttgggaggctgaggcaggagaatggcgtgaacccgggaggcggagcttgcagtgagccgagatttgcgccactgcacaccagcctgggcgacagagcaagactccgtctgaaaaaaaagaaagaaagaaaaggggctgatggccgtgcacccacagaaggccctggctcctggccctcccagcccttctacctgaaacctgacaataggtacaacagaaaaacttggattagagaatcaatatgtcatggaggctcatccccttttcctttatctccatgcatttgctcataatctattctttttctttctttctttcttttttttagagacaaggtctcactatgttgcccaggctggtctcgaactcctgaactaaagcaatttccttcccctccactcagccccttttccttctgatgagtttccaaattatgtattccctgctcaagaatagcagacaggctcatgcctgtaatcccagcattttgggaggccaaagtgggcgggtcacctgaggtcaggagttcaagaccagcctgaccaccatggtgaaacctcgtctcta

SEQ ID NO: 14929 - DNA, 640 bp, Homo sapiens
gggatgaaaaaggacaaatatgacagaaattttagaagtacaatcaagagtgtggtacgttattatggaggaagaaggaatgaaagataactcttggatttccttttgttttgttttaatatattttatgtgtatttaaggtatataacatgatgttataagatataaatatatatagtaaaatggttactattgtggaaaaaattaacatattctttatctcatgtagttacccatttttacgtttttactcctcatggcaagaacagctataatttactagtttagcaaaaactctgaatacaacacattgttattaactatagtcctcatagtgtatgtagagtacattggatcttttgacttgttctgcctgtatatttgctactttgtatcctttgatctacatctcctcccatctctatctctataaatgagatcttgcaacatttttctgtgtagttactggttttttactgagtgactgggtagattttgatgccattaactgtatagaaaacagttatttgttcacttgttcacatttattacatattatgtgaaagtatgtgaaaagagaaatttaaaggtatactgtaattatgctgcaagttaaatgagatcctcactttatccaggt

SEQ ID NO: 14930 - DNA, 11821 bp, Homo sapiens
aaggccaggcacggtggctcacgcctgtaatcccagcacttagggaggccgaggtgggcggatcacgaggtcaggagatcgagaccatcctggctaacacggtgaaaccccgtctgtactaaaaaatacaaaaaattagccaggcgtggtggcgggcgcttgtagtcccagatacttgggaggctaaggcaggagaatggcatgaacccaggaggcggagcttgcagtgagccgagatcgcgccactgcactccagcctgggcgacagagcgagactccatctcaaaaaaaaataaataataataataataataataaacagcttttacaaattaggaagtctaactttactgacttcatacccttgtgaagattatttcaaatccaggtgcctctttaatagttatgtaaaggaaatgagctgatcccatataataccatagaagtgatgaaaggacaaataacagtatgaaatacatcatgctcttcagaagaaaggccctatgtaaactaaaatgtattatgagatgcctttcacaggttaaagaacacaaaatcactttagtatcttctggttagaaagactccaagattagcaagcaagagacaggaacttaaagaactgtagtttgacaagtttttgcttggctagtgctgaaaaactattttaaattctgtacctttctggaatcagaaatctttccttagcttctcatttacagatatccatcctatatgccaattctccaacgggcaattgagctctggtaccatgatccagcctgtactacacctgtactcaagttgatggctgaattggttcataataggtaagcaggaggcagagcttgcaagggcacatctgccctgttatctgagagaatttgctgtatctagtgctttgggcagattgtgggaaataataagattcactactgcattttaaaattcgaaaagtttttgtgtttttgtttgtgtgaaagaatagtattcctaactacacaaaaccatagtcaactgcaggaaataagtcactttttttggtttgtttgtcttgttttttttgaggcggtgtcttgctgtctcccaggctggagtgcagtggcacagtctcggctcactgcaagctccatccccctgggttcacgccattcccctgcctcagcctccggagtagctgggactacaggcacccgccaccacacccggccgattttttgtatttttagtagagacagggtttcaccatgttagccaggatggtctcgatctcctgacctcgtgatccgcgtgcctcggcctcccaaagtgctgggattacaggcgtgagccactgcgcccatctaataagtcacttttaaaaagagtctccagtggggcatggtggctcatgcctgtaatcctagcttcttgggaggccgaagtgggcagattgcgtgaatgcagtagttctagatcagcctgggcaacatggtgaaacccacctctacaaaaaattagctgggcatggtggcacacaactgtagtcccagctactcaggaggctgaggtaggaagattgctttagcctgggaggcagaggttgcagtgagccaagattatgccattacactccagcctgggtgacagagcaagaccctgtctcaaaaaagtaaaataaaaagaatctccagatgtctactcttaggagaagtaaatttggcaaccaagattctgatttcctgcccacagataagaaattaacatctggtaatggtgccttgtccatcacatttcatggttagagacattgagaaggatatgatagatattagaataccctttcttaagaaaggtatttattagagaggttgtggcaggatcaataaaaatttacttttaaaaagtgagcaagattttcaaaacaatttaaggacagtgaaaaagaaaagtctagcaccttagctttcctagaatttcaggtatgggcattggtctctcatggcggtcctgagagaattagtaaggttttttttctttatttttattttatttatttatttagttagttatgtttgatccggagtttctctcttgtcgccaggctgaagtacagtggcgcagtcttggctcactgcaacttaacgcctcctgggttcaagcgattctcctgcctcagcctcccacatagctgggattacagacatgcgccaccacgcccggctaattttctatttttagtagagacggggtttctccgtgttggtcatgctggtcttgaactcccgacttgaggtgatccgcccacttcagcctcccagagtgttgggattgcaggcgtgagccaccaggcctagcagaattaataagttttaaaacaaccttatggagtgggtaatatttaaagaggctataacctcccaggagacttatattcaagagttactcatttataaaatagatacttgagagcacttactctttgccaaactttcctagccactatgccagacaaaatctctaccctctttgatgttacaaatggtggggaagacacacaataaaaacaagtatggaagatctttccagtgattaagtgccatgaaacaaaataaaacaaggcagtaaaatagaggggaattgaaggacaggagggtcagggaagacctctcagagaaggtaatattaactaggatctaaatgacaagaaagattctggtagccctgcaaagataaggagtcttctaaacagaaaacatctgcacgagtcctgagataggacaggcttgctgggacttgtggcaggagcctggttggtggggggaggctgtgggagcaggtcagaccagtgagcagagccagatcatctagtgccttcgcacagcagtagtgaggagtgggcatttattctcattgctgtgggaagccgctagagtgttttcagcaaaggattaaaatgatctcatttaagttttttaaaggctaccatgtgaagaatgggactaaaggcaggtaagagtagaagcagagagaatgtaagggaaaggtggatttggggtttattttagagttagatgttgatggattcagtgtggtgggggggaggaaggaggaaggactcctgggcttttgaggtcttaccaacttgaatctaataaagctcatcaaaatgtggagcagacaaaagagtcaggaacttaaaaccaagatggttacaaatggccttctctgtctggcttcttttggaccattccaagtccctatgcatcttttcttcatataaaatggtaacaatgctttggcccctctccctcagttgccactgaagccataaaggtccatgccaactaatggctgaagggctctgcattagtatcaagaggcgacgggtagaaagtatactttaatcaaggccgggcacggtggctcacgcctgtaatcccagcactttgggaggctgaggcgggcggatcacgaggtcaggagatcgagaccatcctggctaacatggtgaaatcccatctccactaaaaatacaaaaaattagctgggcgtggtggcgggcacctgtagtcccagctacttgggaggctgaagcaggagaatggtgtgaacccgagaggcagaggttgcagtgagccgaaattgcgccaccgcactctagcctgggcgacagagtaagactccatctcaaaaaaaagaaagtatactttaatcaaataaaattgagaattttcaaatagtaattttatctactgctgctttttttttcttataaatgtttttaatttgagcagcagaatctgaatctagcatgttggtcttcaatatagaagctacttcatggttaaatatctataacttggttattctcatattaggataggcaattgcttaccttaatgtaaatgcaggatcacccaaggtactcagatgagagcctcaagtaccccagtcttccaagaaaacacctctgactttttctcctcctgtgctctctgctcaggtcccagcgactccagtttgatgtctcttcccccaatggcatcttactcttccgagaaaccagcaagatgataacaatgtatggtaagtgcttcagataatcatgcctctagaagttaattccagctcagtcaccacactgtaagcagcatgtgggtctctggccagtcctggcaggagccaggacagcattcgtattgtatgctaatacatgtgcattagagtgccacctgtcaccaggggcctactggaatttgtatgcctttggagtaggaaggctgatctaaacgagcgcttctaatgtggttgaataaacatatatgacatgtctactcaggcaatcgcatcctgacactaggagaggtcccaaaggatcaggtctatgctctgaagctcaagggcatctccatctgcttctccatgctgaaggctgctctcagtgggagttacgtcaatttcggagtctttcgtctctatggagacgatgccctggacaatgctctgcagaccttcatcaagctgctcctctctattcctcacagtgatctcttggtaagccttacgctgcattgccacaatcttgttcctcatcacattcagcctttttcacctgagaccaagattgaacactgctcttgagaaactatgtaagctagctccttttgctctaactaagtcttctgttttcccacctaaaaggagctaagctatttaagatcgtctccctgcatgctggagtgcatagtgcctaagctgattttcttcctcttcctctcccacaggattaccccaagctcagccagtcttattattcactactggaagtcctgacccaggaccatatgaactttattgcaagcctggaacctcacgtcatcatgtatattctctcttccatttctgaaggacttactgcacttggtaagcacctgaggtgggtgggtgagttggtgggtttgttttttaccacttaactaaacagaaagagagaatcttgccccagtgtccaaaaagatcaccactgccttgggggtttggccataacaatagagtatataatgcacagcacatgcttatccagcacacactcactgattcccttcctaagtacaaggccctgtggaagcactgaggatacggtaattaacagcatatagtccctgtccttaaggggcttatctggtgggtagaacagacacatgaacaaacaactgcctgtttaccatacttaccacttaaacattacaataggggtgagtacaaagtgctacacaagccctcaagaatacctagactcttggttgtgaggaagtcaggatcaaggaagactggctggaagacttggcatcaaagcataaacctaaaagctggacagatgttaccctggttagccagggagggttcctagcagcagagacagcaagcacttgcacctgtaggcaagaaagaaccaggaaatccagatggctggcacactagtccagaggagttaggaatgaaatgaagctttagagataagcaggagcaaatctggagatcatgaagggggcccgcctgtaagccgtattaggctgtttgaattctgtcctgagggccgtggaagctggggaaaggtttcatgcagctagctccataagttttttcatcctagtccatatggtttctgtcaaccattttgtttctaggctaccttccaacaatttttttttttttttttttgagacggagtcgctctgtcgcccaggctggagtgcagtggcgcgatctcagctcactgcaacctctgcctcccgggttcatgccattcttctgcctcagcctcccaagtagctgggactataggcgcccgccaccatgcctggctaatttttttgtatttttagtagagacggagtttcactgtgttagccaggatagtctcaatctcctgacctcatgatccgcctggcttggcctcccaaaatactgggattacaggcatgagccaccgtgcctggcccaacaatcttagtaggtatatgtgttcagagaataaaacacatttttatattaggctgagcaaaacataagtaggaggattaagtcaactgccaaatagtgatgatatgttgcaaatacacttttggattgtcaactgtggtgaattatccatgcctctgtgcgactttgatacacatttacttctatcagtctatcagggtgcatagccgtatctagtacagtccaatcaaggtatcagcccttgctttggaagacttttttatgtcttattgaaaatacagggacctggccgggcgtggtggctcatcccagcactttgggaggctgaggcgggcagatcacaaggtcaggagctcgagaccagcctggccaatatggcaaaaccctgtctctgtacaaaaattagctcggcgtggtggtgtgtgcctgtagtcccagctactctggaggctgaggcagaagaatcacttgaacccgggaagtagaagctgtggtgagccgagatcgtgccacttctgcactccagcccgggcgacagaacgagactccgtatcaaaaaaaaaaaaaagaaagaaaaagcaagtagagggacgtttgcataaactatcagtcccgtaggaatcagagacttgtttactcttttaagggttcagcccctttgtcctttggccttacctcatcagagttctgtccacaggttgtgctgtactgttccctttgtaaagacgcatagatgagtctgcagctccccccagagatgctttggagataaacagataatacagcataccgtgttctaacaaaccataaacattcaggggctacgtcattctgggtttaattacatcccactggtaactcagagcataggctcataccccaggcttcttggattctaatcacagctcctgcaattactagcagttgatccttaggccgatacataacctctcctaattctggtttcctcatttgtaaaacagaaaacctaattcctgagttcttgagaggataaattagagataacacctataaagtacttagcacaacatctggcacaaaagaagcacttgctgaatcaaactatttgttattttgtgtgaggcagaagatgtacgtacatccacaacacattgagccgataatttcagtattctttattaccacatactcactttcaaacttagaaattgagccctactgtacaatgaggttaagaggttaacaggagtcatcttgagcaaccgccttggttgaattggccacggtaccctaatggatctcacccaaagatagtccatatttgtccaggccaccatcagcagctctgtcctacccctgcctttctttcttgcagacaccatggtatgcacaggctgctgctcctgcctggaccacattgtgacatacctcttcaagcagctgtcacgtagcaccaagaagaggaccacacccctgaaccaggagagcgaccgctttctgcacatcatgcagcagcatccagagatgatccagcaggtaagaaagtggaggcttaggaggcagtgatggggtgtccgacagaggaaggacctctgcaagacaggggagcccacacacgattaacatgacatctcatcaggttcctgctgctgagatgaagtccgtgtcttaaagttgcagtggattttgagtttgccaagtaatcactggatgtagaaaacgctcaggttctggattattcttctgagtgtcacagtgatccctatgccctggacctgtctcatgatcactatcctctttctgtgaaaattactttgctcacccactgctataaatagagcaggagttagcagcatccagctttctaaaggcttgtgttcctgtttacaaaacaggaagaagaatgcaagacagaaggaaataactggccacagagagatcaaaccatatgcttgcccttattttatttgtatgtgccttgaagtaacttacagaaatacatgctagatgaaaatagataaggaaatgggatcagtaattattgagattttagccagtcttacctttgtccacaccgttctctaaagaagcagtgaaataattcaggactccattacattcacaagatgtcataaagctgtcaactccgagtacctggaagggatcatgcaaggtggttttgcttactgtaattttgtttacgtgaccccatcccattccccacaactcagggtgacctggaaagatccattggtaagtgaagttcaaaccaattttaagaacaagaaaggaaatgaatatcttagaagaaaaggtaaccttgaaatagaagactcagatgaagcttcacaaactatttgtctgatttaccctatacagaaaaggccttcagcctaatatactcctgtatttggaatctgtcgttttatcttgggtagcaatacattaggtcactgcctgaaattctccattccattttcagatgctgtccacggtgctgaacatcatcatctttgaagactgtaggaaccagtggtctatgtcccgaccactacttggcttgatattgcttaatgaaaaggtgagagagccagctccctggtgccaacccagaagcagtggcaaccacgcacttggtatcaccaagccctgggagaaatgtgtatagaaacaccccacggtggtgaaacagggaaaatgggtcatttactgagcaagtcccatttgtgctttcagtatcacataatcatttaactgttagaagtcagcatgtgtggtagctcacagacacaggataaaggagtgtttcccctaggcagtaagagaaacctttcaaggaaataatgtacctgggtatcagaggacctaagacctaagttctagttctagctctgctataaacaagtcttgagattctggtaaaagaaaggtctggataagatgacccttttaaagtgctttacaatttaaaaattcttgatattcttagtaggatgaagccatattatcccacaagtgcttgcctgaatttcttttttaagggtccaattttagtagacattccattcctccttagagaagaacattcttcaaccctgcagatgacggagggctaatctgccttcccctgcttctctaaccttctgttccactccttgccccacagtatttttctgacctaagaaacagtattgtgaacagccagccaccggagaagcagcaggccatgcacctgtgttttgagaacctgatggaaggcatcgagcgaaatcttcttacgaaaaacagagacaggtgagtataaagcgtcctgcctagaaatctcagacaattgctatttttcaaatcaacgaaacaggcagttgctttaaagtctttgacatctgtgtttggaggccatctaaagcaatgcaatgcaatagaaaagtgagccatgttaaacaggcaaaattcattttaataatatattttatttaacccattgtatctaaaatattgtatcagtgtgtaatcagtattttaaaattgtgggttttcacattctttttgtactacatttccaaaatcctgtgtactttacatttaacagcatatctcagttcatacgttttcatcagaaatacttgatctgtatttagatttcataaatttacagttgacaaagtagattcctgtaatacccagattgtttcaaacacacctagggactttccagtaactgcattgagtatctgggctttgcaattaacttttaaattttatttaattttaattaatttaaaacaaggcattttaatttaaaattaagatgcagttggggagctgaatgttaaattgtatttaatttggattcatgttctcagtcacactggccataattcaggggcacggtagccatatgtggttagcagccgccctattggacagcatagcactgcaccacctggtcttgctgcattaagaaatgagatggcttcattggcttactgccctcacgtgtgagggcaacttcctacttctgtcagtgagatttcttttgtgctgccatgagcccaaggtagccctcagggccccagatttgaccagatctctaagccaacttttctcttagagtcttaagactgaaattaactgatctttgaaacagaacccatcaattcatacattctacttcccatgctttaaaaaaaaaaaaaaaaaaggcaaatacctttcccccccactctcctcccccaacccacatgcatcctctctgcaggttcacccagaacctgtcagcattccgtcgagaagtcaacgactcaatgaagaattccacttatggcgtgaatagcaatgacatgatgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactgacctgg

SEQ ID NO: 14931 - DNA, 1542 bp, Homo sapiens
ctaagaatttggctgccagaccccaggcctggctgctgctgtgtggagagggaggcggcccgcagcagaacagccaccgcacttcctcctcagcttcctctggtgcggccctgccctctcttctctggacccttttacaactgaacgcatctgggcttcgtggtttcctgttttcagcgaaatttactctgagctcccagttccatcttcatccatggccacaggccctgcctacaacgcactagggacgtccctccctgctgctgctggggaggggcaggctgctggagccgccctctgagttgcccgggatggtagtgcctctgatgccagccctggtggctgtgggctggggtgcatgggagagctgggtgcgagaacatggcgcctccagggggcgggaggagcactaggggctggggcaggaggctcctggagcgctggattcgtggcacagtctgaggccctgagagggaaatccatgcttttaagaactaattcattgttaggagatcaatcaggaattaggggccatcttacctatctcctgacattcacagtttaatagagacttcctgcctttattccctcccagggagaggctgaaggaatggaattgaaagcaccatttggagggttttgctgacacagcggggactgctcagcactccctaaaaacacaccatggaggccactggtgactgctggtgggcaggctggccctgcctgggggagtccgtggcgatgggcgctggggtggaggtgcaggagccccaggacctgcttttcaaaagacttctgcctgaccagagctcccactacatgcagtggcccagggcagaggggctgatacatggcctttttcagggggtgctcctcgcggggtggacttgggagtgtgcagtgggacagggggctgcaggggtcctgccaccaccgagcaccaacttggcccctggggtcctgcctcatgaatgaggccttccccagggctggcctgactgtgctgggggctgggttaacgttttctcagggaaccacaatgcacgaaagaggaactggggttgctaaccaggatgctgggaacaaaggcctcttgaagcccagccacagcccagctgagcatgaggcccagcccatagacggcacaggccacctggcccattccctgggcattccctgctttgcattgctgcttctcttcaccccatggaggctatgtcaccctaactatcctggaatgtgttgagagggattctgaatgatcaatatagcttggtgagacagtgccgagatagatagccatgtctgccttgggcacgggagagggaagtggcagcatgcatgctgtttcttggccttttctgttagaatacttggtgctttccaacacactttcacatgtgttgtaacttgtttgatccacccccttccctgaaaatcctgggaggttttattgctgccatttaacacagagggcaatagaggttctgaaaggtctgtgtcttgtcaaaacaagtaaacggtggaactacgactaaa

SEQ ID NO: 14932 - DNA, 5920 bp, Homo sapiens
cagacatcacggctgcagccctggctacgggtgcctgcatcgtaggaatcctctgcctccccctcatcctgctcctggtctacaagcaaaggcaggcagcctccaaccgccgtgagtattcctccctgcctggggtgggtggacggtgcgagtgacctgctccagcccccagttcagcccctgggattcgcaaaggcacgatgcaggcacaattccttttcatttgagagttgggagcagctgcacttcccgccaggagctgggcgaaatggccgagagaaaggaggcatgccatttccgggggccaagtgcccaccagcccctttggctcccaggcagtgctggctcggcactcaatacatgtcttctgaatgaatgatcatatgcagtagctcaagttgctttataaaagcaagttgctgccactcagagatccttgggggacctgtttaaggtatgggcgtgcttgttttgtaattagtagcaattgttgggacaaaaaatgatctttggaatatcagaagtggaaggggtcttacagacaacttagctcaaccctttctttttccagatgagaaggctaagatcagtggggttacataactgactgaatgttacgtaacttagtaagtggcagagctaggactcaatctcagagctttcaacgcatgctctttccgggaatagaagtccaccatataataaaaatgctctcacttactcctcattgcaagtccaagaatttggtcctaccattgtccccattttactgatgggcaaacggaggcacagaggggttaagtaacttgcctaaggaaccacacagcaaataagtggtggggctgggctttaagtcatgggcacaaacatctttcacctcccaccctggccaggtgacagtgccccttgcctagttcctgaccctgcccttgagtcttggttagtctgagtcctccaagaaggggctagggagttttttacccttgcctcccctccctggcctcttcccgtctgcctggctacagaggtaactgagaaaggattgctctggtgccaggtggcttttggctcgcaacttatttcctgtggccggcccttaacaacttgtcatccctccctcccctcattcccgggggcccccacgtgaagccccatagtgggtcactcgggggctgtggccacctcacccttgctttcagaactcccctattcctctcctagaacacaccacaacctacctgcaggaatacccatggctgggggtgggtgggggcaggtaaagggcttggaacagaagagcaacgctgggcagcagggcagggggagcaggtgttgctgtgccctccctggtggaaggctggcccagagagcctgctcaggaatgaggcactctcaggaaaaaaagaaaaggaaagggctgggagccttgaggacggcagtttgctggagaggccaacaggtgtggatttccatcctgctttggactgagcctcagtttccccagctctaaaatgggaccaacaaccctcaccccaaagggtggcacagaggatgagatgagggaatacccgtgtgcacctgcacgaagcctgacccatgagtcggctgtaagcaatagccatggtttgaatagatttcaggaacttttgggtaacttccctgtgtttgttctgttgttgtgcccctcccccaccatctgtttccccatcgtaatcagcagtaaatctccttaaaacgagaagcatctgtgggaggacatggggtgctgcatgaaagagggaagttggggtcactgcatctaattggtggccagtttggggggtggggtgtcccaaggctgaggcaagcggcagcaacttggatgagaagcagaaagtgagtgaagtggctgggaagtgatcggggacttgcaccttgtaaggtttccctgagagatgtcccctagaatgccaccctattaggcaatgtaggggataggacagagaggaccaggagccctctaattaggaactgaccttaaacactcccacccagtaagtcatggctaaagaccagaacctggcaaatgttcaaacaagagacaccagttagcaaattcaagagttgacctttgctcgatacttaaatcctgaaggtctgacactgtgtaagtcaagccataggagaaagcgctggctgcctttggtctcctgatggcagatagcgttcttacactcctggaaaatgcagatagagtttcatttatcagtcgtcaaaatgggcccctcatggaggccccatctgctggacagacacgcagatcgcttgctggacagcacccatgtgaaaagaaatggagtccggagctgtgcagggccctcctgggctcgctcctgttccctgcagggcatctgccagcaggggcagggatgttgtatggggaagccttcccttccatgaccagcttctctgtctgtctgtccctaggtgcccaggagctggtgcggatggacaggtaaggcccatggagaccttcttgagaaaacttcctgggccggctatccaggaagagatacttctgtgcagtaggggccctgtttagctgcctagagcagctggtcagaagagcctctgccatctgctgctgaagcctgcacatctgtgcagattggctgttctcctgccaccccgactcagcaggctgagctctgattctgctcagatgtgtcatgcacccaccttcgggtctcagtggtcagcctgggccaggatggggacagggaggaagcactgtctggggcagacagtgagacatgcaaaggaggccagcgggcccagccccagccacagcccttgagctgtgcctcctgcccgcagagaactccaaggagaaagctgttaggccgctgcaggccacaagggcagaggctgaggggtcccagagtggtgcagtgggctgggtctaggggcagaggggatggggactgtgtattggtgtgctctgggcaggaagctgccatgcagcctggcctggagggtgtgttcagggaacccaagttcctgccccggtacctgcaacaccaaacacaaagctcctctaggtgtttgaaagggatgatcttcaagacaggttgaaggaagtcctgcttgcaactcatctagaatctaagagttgcaggggtcttcagaagttatcccactcccaactgggaagagaagagaacccctcccctcagctcaagacaggctttggggatgttcgatcctaatgccatcaactctattgaccaaagagaaacttgtccccaaattcctgaggctgaagttctagaagtgtctgtgatttttggcttcctggctgtgcccggggttgatggtcagaccacagggaggagctggggtctgttctggtgggccctgatgccctcagctcaggacaggtgggcaggtgcagcccatggcctttgctctgtgggcctggctcctgccttcttgcttggagatgctgctgaggcttggggatggggatgtaggtgagagaaagggaggagagaaaaactgggggcagggagggcagagttcacgctccggacagcacagatgaccttccattctggttctgtggcagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctgggtaagtgtttcctgaccttcacagcacgatgacctgtaaggtcatgacctcatggcctgcagggcatcggcctcactccctgccctccctgaagagttccacggcctcacggggtggggttgagggtgagggacagaggggcccccattcacctccctgaagagttccacggcctcacggggtggggttgagggtgagggacagaggggcccccattcacctccctgaagagttccacggcctcacggggtggggttgagggtgagggacagaggggcccccattcacctccctgaagagttccacggcctcacggggtggggttgagggtgaggggcagaggggccccgttcactttgcttctccttttcttgcagaccctgtccctgactctccaaactttgaggtcatctagcccagctgggggacagtgggctgttgtggctgggtctggggcaggtgcatttgagccagggctggctctgtgagtggcctccttggcctcggccctggttccctccctcctgctctgggctcagatactgtgacatcccagaagcccagcccctcaacccctctggatgctacatggggatgctggacggctcagcccctgttccaaggattttggggtgctgagattctcccctagagacctgaaattcaccagctacagatgccaaatgacttacatcttaagaagtctcagaacgtccagcccttcagcagctctcgttctgagacatgagccttgggatgtggcagcatcagtgggacaagatggacactgggccaccctcccaggcaccagacacagggcacggtggagagacttctcccccgtggccgccttggctcccccgttttgcccgaggctgctcttctgtcagacttcctctttgtaccacagtggctctggggccaggcctgcctgcccactggccatcgccaccttccccagctgcctcctaccagcagtttctctgaagatctgtcaacaggttaagtcaatctggggcttccactgcctgcattccagtccccagagcttggtggtcccgaaacgggaagtacatattggggcatggtggcctccgtgagcaaatggtgtcttgggcaatctgaggccaggacagatgttgccccacccactggagatggtgctgagggaggtgggtggggccttctgggaaggtgagtggagaggggcacctgccccccgccctccccatcccctactcccactgctcagcgcgggccattgcaagggtgccacacaatgtcttgtccaccctgggacacttctgagtatgaagcgggatgctattaaaaactacatggggaaacaggtgcaaaccctggagatggattgtaagagccagtttaaatctgcactctgctgctcctcccccacccccaccttccactccatacaatctgggcctggtggagtcttcgcttcagagccattcggccaggtgcgggtgatgttcccatctcctgcttgtgggcatgccctggctttgtttttatacacataggcaaggtgagtcctctgtggaattgtgattgaaggattttaaagcaggggaggagagtagggggcatctctgtacactctgggggtaaaacagggaaggcagtgcctgagcatggggacaggtgaggtggggctgggcagaccccctgtagcgtttagcaggatgggggccccaggtactgtggagagcatagtccagcctgggcatttgtctcctagcagcctacactggctctgctgagctgggcctgggtgctgaaagccaggatttggggctaggcgggaagatgttcgcccaattgcttggggggttggggggatggaaaaggggagcacctctaggctgcctggcagcagtgagccctgggcctgtggctacagccagggaaccccacctggacacatggccctgcttctaagccccccagttaggcccaaaggaatggtccactgagggcctcctgctctgcctgggctgggccaggggctttgaggagagggtaaacataggcccggagatggggctgacacctcgagtggccagaatatgcccaaaccccggcttctcccttgtcccta

SEQ ID NO: 14933 - DNA, 17413 bp, Homo sapiens
agctgaatggatgtgaaacccctgtgggcatgtgcttccgagttcctcagcaggcatttgtgttttttggtagaaagtttgctttttgttttttttttttttaagacaaggtctcattctgtcacccaggctagagtacagtggtgtgatcatagctcactgccgtccttgaactctcagactcacgtgagcctcctacctcagcctcctgagtagctgagactacaggcgcttgccgccacccctggctaatatttttattttttgcagagacaggggtctcactacattgcccaggctggtctcaaactcctggcctcgagcaatcctctcacagcctcccaaagtgctggtattacaggcgtgagccaccacacctaacaaaagtttgctttttatctaaaatgacccaggcattgtcactgtactgctatttttttaaaaaaattttgttgttttgttgttgttgtcgtcgttatatagatgagggcttcctgtgttgcccaggctggtttctgacgcctggcctcgcctccttatacaccaggacagcaggactgagccaccacactacccaactgcttttatctcagtgaatgaaaatgatacttgcctggaggcttcccctcatctacccccatgtttctctatttattcctcagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccagtaggcggtttggtcccttcctctccccacccttccctgtccctccccactggtctgttcctcggcccctagagggctctttcatcctctgaatgtcagttactttttctgtaacacctgcccacctcgaaggactagtgtggggatttgatggattgaggaagttctagtgttatagtaaggtaaacaatggaaaaagccactgtggatatttttggttggaaaggggtggctgtacagtgaattgcagggtctaatttcataagcgtgtctctgaattctcaagttggtactttaatgttaaactacgaatccagtctcgtcatttgaagaaagctgagcagtgctggtgtaatccttgattttccaggccacctggcctagcagagccaccaagggtgtaaggtgggaaccatctcaacggttcccacctccagaacctctccctattatagttgtcatgtcaccagctctctctccccttcctcatgggatcccacgtttgggaaccctttgtggctgacatcaccatttcctgccactgtccaggtggcctcaattcacaatggcttctgccactttgacttctgcctcaaccatgtatgttcagctgggcacttgattggcaaaggcagaatctaccctgggtgatttaagctaaagggaattcatcgaaaggccattggagactccagaactgatgggaggtagggggtcaggctaggaagaacaggagccaaggatgtgttggaggaccagggtgtgagatgaccccttggactctgggtcatgtgctgaggtctaaagatcttgtggagtgtgtctgaggtgctgggcttgggtcagccacctggcctgctggttcctgtagaggaagagccaatgggaggtagaggcagggaactgcccttgccccaagataatgcatgatgcagaaataatttcccatggcgaagggagacaaagcaatgccaggcagctgcataccaatgaatgccaccatagcacggctgtagcccccctgccactgacaggctgtcttcatttgctaaagcctaccatgggggaagggacctttcctctcagctctgaggatgcttagaggaagactggtgtgttcagtttagtcctcactgacaagaaaataggagcatgacctggtggcattagaataacagtgtcctttgtcaaactcattactctccctgccagccacaagtcactctcccagggaagcctcaacccctcaactctctctagggtgagctccctaccccaagaggacaccccacctctcaaaggtttctgacttccttgtcccaaaatattaatccttctgctccagattccaatgatcagcaccaagaggtccccttttccttctgccaggcattggccctgctgataggactcttggtcacttagttaaaatcacagtggcccaaggaagaacctcctgagcttgattaccctcactatggagcagaaggacctggccctggacacaggggcggtgcacagtataaactaaccactgcctgacctgagctttggctgaaatgacacacaggcctctgcactgcccacctctccaacctgaggcagaacaagtaggcgatgatttgcactgcatgattctcagtgtgaaagtctatgttggcaaaggatatttcaagtggaacttagaagctattccttaaggctaggacgaacaccacgctacacgcgaaggctatcctatttgataaagatcaaaaactagcaaacaaaaatctccagctgcccacgttgctttggtcatgacccttccttcagatcacttctgcctttatttttgctgtttaggggatgtgttatcacagaaacttggaatgcagagaaatgttatcacagaaacttggaatgcagaaaaatttttgctttttaggggaggtgttatcacagaaacttggaatacaaagacctccccccaccgcagccctgccccaccccacctaccccctgctggatttagcactgcacttccattttagcagtgatttccttcctttttgccctcgcctgccttccagtaacacataatttccttctatttccagagctgtcgatgatgaaatcgaggccaatcttgaagaggtatttgtaactctttgaatttcacccactctgtcctggacaatccagagagcagaggagcaaaaaaactccaagagtttttggacttcacgaacaaagcctgaaactaaggataaagccgggtactgggaatccaagagtcgactacctgcatcagctctggcctctgtgctgggggcatgggccagtcccttgcctattgggctgtgctagccactgtcaaaatccatccacaacattccagctagtctttattcttctgagtccccactagaatagatcctaaaaggccattttaattggatgctagagaagatacctctgtgagaaattagaatattactccttcccacataatttacattccttcttgtgttttaattagaaaaaaaaaaccttatattaattcttcacactatacctgatcttaacccaaatcaccgtagaatttgggccccagggaggggtagagaaggggagtgggaggtggctgccatggaagggcgggcagacacttggtgtcatgcctcgctctgatgcattctcatgtctctgcctcaccttccagttcgacatcagcgaggatgacattgatgatggattcaggagactgtttgcccagttggcaggagaggtaaatgttcccaaaaacgatgttatgcactctggttgatgcaaaggaagagacagtgtgtgtccccaaggggactttagtttaaaggggagaggaaacaaactgaacaaaagcaaagagaaattgcaaatggcacttgggttccagctcagccctcttgcgtgtgtcctccctaagacctccgcatgctgccgggggcttccatttgcatggtcagccctgactctgtgttcctccttccttaggattcctgggctcaccttgtgactgttttattttctctgttctacaccaattgaggcatgaaacttggccccttatccttgatttccacaaaggatttggagagatggaagggtttcaagtctcaagaatgcaggccacctgcaacagagtgtttgaattaggcttttctgttctcttttcttttttctttttttctttttagagacagggtctctctctgtcacccaggctggagtgcagtggcatgatcatagctcactgcagcctccacttcctgggctcaagagatcttgccaccttagtctcccaagtagctgggactataggtgcacaccaccatgtctagctaatttttattttatttttatttttgtagagatggagttttgccatgttgcccaggctgctctggaactcctgggctcaacaatcctccaaccttggtctgccaaagtgttgggattacagatgcataccaccatgcccagctaatttttaaattttttttagagacagggtctcactttgttgtccaggctggtcttaaacccctgagctcaagcagtcctcccacctcagcctcccaaagtgctggaattacgggtgtgagccaccatacctggccacttccctgttcttaaaaaaatccctcagccatttagtcccatcacaaagttatttagccctctttcttcccaacaactccaaaaaaaaaaaaaaagtcctctttcttcactatgtggaggaactttccaatcattgagctcatctggtactcccttcgctgacctaaagacccatcaaagtactaagccaggcatcgtctgctctgcgcctccaccggcctctcaccctctgctccctcccagattcccaaggaaaggggccatgagagtcttctttcccctctgattgaatcccacacatacacaccccaaaaggcaaacatgactgcaatcaatcttggttttaaacaaaggagtttatccatgagttacacaaatatgtgtaagtggatagagacatctgagcccatgaggggccctggcatgatgggcatagaggagggccggctaggtcttggagacagctggttttcaccagttttacaggaagtctgagctttgagttttaaagaatgaagaaaacatgccagataagaggaatggtataagagaattaagaaagaccacaaacatgggtagaggggagtatttattatttatattctctacagcaaagaaatggtgagtgaactctccctactgcatccgtacattaaaacaccgtatctaggctgggcacagtggctcacacctgtaatcccagcactttgggaggctgaggctggaggatcgtttgagcctaggagtttgaggtttcagtgagctaggatcattccactgcagtccagcccagcctgggtgttctaaaaagaaccaaaccaaaaacactgtatctaaaatccagaatggggcagtactactcaaagtgtggtctggggacagcagccccaacatggctcgggggcttgttagaaatgcacattcataggccccaccgcaggcctacctaatgcactggtgtcctgccctgtgctcatccagctcccacggggggccaataactatgctctggttatgtgtccacaggatgcggagatctctgcctttgagctgcagaccatcctgagaagggttctagcaaagcgtgagtatcccctcattgcaaaacctcatcctgctctttcccctgtggatgggagggaacatggaaatctttccccctccatgtctggctgctgtgactaaaccaccaccctccatcccctccaagaagtggatgaaggatttgtatgatgtgatgaaaaagaacaagtgtttgtagcatccacagatcaaagatcaaatccaggtttccactacatactagctttgtgtgatctatttttttaatttattttattttatttttgagacagagtctcactctgtcgcccaggctggagtaaagtggcacaatctcagctcactgcaatctctacctcccaaattcaagcgattctcctgcctcagcctcccaagtagctggaatcacaggcaagtgccaccacagccagctgacttttgtatttttagtaaagacagggtttcaccatattggccaggctggtcttgaactcctgacctcaagtgatccacctgccttggcctcccaaaatgctgggattacaggcatgcactaccacatccagctaatttttgtattttcctagagatggggtttctccatgttggccaggctggtcttgaacccctggcctcaagtgatctgcccacctcggcctcccaaagtgctgggattacaggtgtgagccaccgtgcccggccacatcttgtaactaactatttcttaagcaaaaaaatgtcagaggattgattgttcaaccccttactgtggatcaccagcagggaggagcgggaaacacaacacagagacattttttcccctcaaattatcaaaagaatcacgctgcatttgttaagagagcaactggcaatccaggaagcagagttttgaacatatcagaagttaggaatctgcatcagagacaaatgcagtcatggttgtttgctgcataccagccctagggatcatctcgagaagcctcatggacttcaagggacatcattccctctgacaagatggcctctagcctaactccatgagataaaataaatctgcctttcagagccaaagaagagtccagggccagctgggtcttccctcccagtgtgaaccaagagggctgggccagtcaggttacggtcagtccagtgcagggcctccccagaggagacccagtctgcacccgccctcctctaattttcagggaaggcaagaagattgtgtttaccctggaggccaccaggcacaagtgaggtcacagagctcttcagatatgcagtcctcatgagctgaggagactaaagcctcattgtttctgcacagatggagggtggggctgggaggtggggaagaagcgggccttgcctggattcagcccgctccttgctgggggagcagcattcgctccgcgcgtgcctctgagcttactaccctacccctagctgcctgctgactccagccttctggagggctccacaccagagtctgcatgcacagctgctgggccagagccttatgaccatctaaggggttggtgcccagagtggcagctttgaggcaggtcaggctctaacctctttcggggacataacaaaaaggctgggcttttcgtgaagtctgtggggagccaggttcacattggtgactagggagggtctcatgccacctgccaaacaccaagtggacaggactcacttagtgcagcacaaatagctcgtggatcgatcccagttcctcaggtttctcagtcagctggggacacagtccataaatgtctgcagatggacagttcaagtaaacctctttctctcacgggtcatagcctagaattaacacacctgctctctgttttctttttccctgcccaacaactacaggtgactttatatcctgtgggcacctaaggcccaaccattgatcattctgttatttatttgttcaaaaagcactttttaaagccctgtttgcccacggcaaatatacagagacatcaggacaatgtggacatcatctgcactgtcccagtctggtagtcactagccacatgtggctatttaatataatggaagtggcttctgtatgtgaagggcacagataaagaatatctccatgattgtggaaagttcagttggacatcaccgctcagagatttttcctgtcacactgattttgtcttttaggccaagatatcaagtcagatggcttcagcatcgagacatgcaaaattatggttgacatgctagatgtatcctttaatgtgctccagggaatagagactgggggagtttaaaatctcactccagaaagattcaaacacatggccttctcccttttcaaaatagccagttgttcccaacttgctgagttgctgtcggacagtcagcagcgctgacctcccttactagggaaatgcgagaaccctctgatgagggaaagcaaatgctacaccccccctcccacctaccctgaaaggcttagaatgcaggcccatggcgggcggtggctcatgcctgtaatcccagcactttggaaggccaaggtgggcctcctgactcacgaggtcaggagttcgagaccagcctgaccaacatggtgaaaccttgtctctactaaaaatacaaaaattagctgggtgtggtggcgggcacctgtaatcccagctactcaggaggctgaggcaggagaatcacttgaacctgggaggcggaggttgcagtgagctgagatcgcgccactgcactccagcctgggtgacagagcgtgactcatcgccaaaaaaaaaaaaagaaaaagaatgtaggcccaccagtccattcctggggctggtgcgggaaattcctgacaatatgcccatcacttctttgcacaaagcagctcgaatttgtttcctcagtgatgtgtttccattacttcctctaggaaaatattccctaaccacagtatttctgatgtgaatctgttttgtctgatcaagatcgtcgtcttctttatttatttatttatttattttttattattatactttaagttttagggtacatgtgcacaatgtgcaggttagttacatatgtatacatgtgccatgctggtgctttgcacccactaactcgtcatctagcattaggtatatctcccaatgccatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgagccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatgatatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattatggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagataagcaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggttttgatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttatcaaagatcagatagttgtagatacggcgttatttctgagggctctgttctgttccattgatctatatctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaaggtccttcacatcccttgtaagttggataagatcgtcttcttgatttagataagggctactttcatgaggatcctacttcccttttgctctagctccttcccaggccacccacctttccccaaggcaaactagtcatccatttcccccttgtttccaatgcttagtgagaagtggtggtaaggggcagcctaagcttctgtgaagttttttctgtttgtttgtttagttggttggttggttttttgagacggggtctcactgtgtcacccaggctggagggcagtggcatgatctcagctcactcgaacctccgcctcccaggttcaggtgattctcccccctccagcctccctagtagctaggactacaggtgcgcgccaccatgcccagctgatttttctatttttagtagagacagggtttcaccgtgttggccaggctggtgtcgaattcctgaccacaggtgatctgcccaccttggcctcccaaagtgctgggattagaggtgtgagccaccatgcctggccacttctgtgaagttttatctagtggattcatggtgtacacctgctagctcccttcaccaaaggcctcttagatatactccacatactttaaaaaaaacagcaagggcctagccactagaagccatccaaagccctctgcatgtcatccaatacctcatttttagtagtatctggggcctccacagcacccctagatcaaaacagcaaccagattcggcagggagccagcaggtctttctcgcccttcctccaatcctttaaatggaggtttagccagtgggaaaagcaggaaaaggatccttctgcaaaccctccttgtgtatatgctatgatattcaaaagatccagttgagaagacaaactaggtgacactatgtgcaaatggacccacactcaagggctttccttgactgaaggcagtcggacgggagtggcaagctggggctgaaggagttctacattctctggacgaagattcaaaaataccaagtaagatcccagagatgcgggtggatctgtgttgggaaacattctgttcatatgctttaagatgcagcaactcctgcacagagtggagaaacatttccaaggggattgggattttacccataatgaagctcagagtgagtaaagatggggctgaggaaatgcaaacaaaaaaccaaccaggacttcgcaggtgaaatggcctattcccttcctcctgattattgggatcatctaaaggccaccatcaagggtttcctgaaaagggtttttgacagctaaagtacaaaaattatataagacaagaacatggacctatgggcgttggctggctgatttgatgggcatatttacaaaccagctcacagacagaagcaaaatactattagttatttaaggcagaaacataagtgattcttccacggccaaactagaggcacagagctggaaaaacttcatccccactcagcacatactagggaggtaacttgccagctttgctttgggtcatagttcttacagctaacttatgtgttccagaaaatttaccgagaaatcgacgttgacaggtctggtaccatgaattcctatgaaatgcggaaggcattagaagaagcaggtaaccctttataactgcattttcgttcctagtttaatctgtctgtagaatatgtgaacactcatcttataccatataacacaagatttggtaaagctataaaataaagtaggtgctggtttaatacagacacctccttttcattcccctttcaaagactaattggtaaaattaaatgcagtaggatgctctgccctctgtgccttcttgaatccaagtttcctttggagccgcctggcacagtaagcaggcaaagccaggtctcaacagcctcctccaggtgcttcctttctggtgcagggttggttaggcagaaatcaaatgtctcagctcagcccttagggtaagaccctagcagaattggatatcaataaaaggacacaagcgagtggtagaccagcaaagcaggagactgctgggctttgggaacaaatgtgtcagcatgaggctgttcattctatttgctggaatataatgctgctgcagagaccccacacaacattggtttatacgaggtatgtctttctgtcgtatagcaatcccagctccagcagtccacggctaggacggtgcctcctactatcctaccatgtcactatctgatcacgcttcccccagcctccccccatccatgatgcccaccggaccttcaagggtcaccctcatccaagggacctgggacagcctgccaccacaaacacatgccaccaacaggttgacagaagaagggccccttgcctttaagggcacacaggccatttccggtcacacatcccaccagccagactctgatcacaaggcctctgttgactgcaaggaagctgggacatgcagtcttgatgctaggtggccataggctcaataaaaattattttactctggaaggagagagaactactatgagtttaccaggaaagcttctgctcacatatatccaggaagaatctgatcttcaagacgattgagagctaaacaaaaaatcaaacagcagcagcatggttaacaacatgaagcaactgtgaccatgagaacagaaacaggcaagaaaacacttatgtgtcagcaaaggacacaggcagggtgaaggtggacagttcaaaaacaaaagaaacagcagaaggtactggctttgcaaaatcaaaccagtctcacagaagagcagccaagggacaaaagcaattatacctcatttaaatcaccacattagtttcatagcctgtgagcgcagctaaatggaacaatctaatgcttagcaatgagtttgtttgttcatgtaacttcaggtttcaagatgccctgtcaactccaccaagtcatcgttgctcggtttgcagatgaccagctcatcatcgattttgataattttgttcggtgtttggttcggctggaaacgctattcagtaagtggatatttggggaatgactcatttcagttctcttggtattaaagtggcctgcctttcacctcggtgaaatcatctaaactagagacatgtcttccaggagttgagaatgaaattccctctttactaatttgagggtgaggaagaaagcatgtatggtggtcagtgaagtcagttgctgaactgaaaagaggataatgtgatctgtttcagctcactcacttgtgacaccctctttttctccctccacagagatatttaagcagctggatcccgagaatactggaacaatagagctcgaccttatctctgtgagtcagcaggccccgccttgcttctaaggggatgggggaggcatggggcggaaagggctgttacttgagtgatctgctttttcaagttttgctttaaagagctcttggtctgtcggggccaggcctgtaaccggttgtaagatcccacaatgcacttttacttgcagttgttttccaaccacctattctcaagtccaaaatgcacgcctggctccctcttctcatgagctttgacttgagtgtagctcaaggttaaactaaggagtggctgcaggatcatgcttagaaaaatgaactcctgattagcatgcaagggagaacatgtttatataaagaaatccttcagctgaaattcaagttgggttttgggaagatccatcattcttagagtggatctacttaaaatactttaagcaaattagttttctctactccctccccgtttaagataaaaccaatactagtaaatacgtttgccatttattattgttattgcactcatgtgtctggaaccctagcaatacacatctctgaaatgatcatcaatctgaattaagtgggtatgctaatttcacaaaaagcaaagcgtaaaatgttctcgtgtcatcccaatgacaggaagttctctcactgaaagaaagaagccaggtggggtatacttccattatcacctggctccagtcagcatttcctctatactcagggaaggccacagagggccgggcgaagtggctgacactgggtgagaatggcagttgtcagtcctgtccgtgtaacagaggagtgaagtggtgaggagggcaggtctaaggcactggcagctcttttccatggattttgaactctggaggaaggcagcaactaaataactgtctcattctgctattatgcattgtattagcaaagtgaaaatatagtctatctggttacaaataacactaacttgcttaaaactttacatatcctaggaaatatctctacccctagattgcaatgtagagtcaaccccatctctaaaaaaataaaaaattaggctggccgcagtggttcatgcctgtaatcccatcactttgggaggccaaggcaggtggatcacctgaggtcaggagctcaagaccagcctggccaacatggtgaaaccgcgtctctactgaaaatacaaaaattagggctgggcgcggtggctcacatctataatcctagcactttgggaggccaaggcgggcgaatcacctgaggttgggagttcgagaccagcctgagtaacatggagaaaccccatctctactaaaaatacaaaattagccaggcgtggtgacacatgcctgttaatcccagctactcgggaggctgaagcgaaaggattgcttgaacccgggaggcggaggttgcggcgagctgagattgcaccattgtactccatccagcctgggcaacaagagcaaaactgcatctaaaaaaaaaattagctgggcgtggtggcaggtgcctgtaaatacgttactctggaggctgaggcaggagaatcacatgaacctaggaggtagaggttgcagtgaactgagatggtgccactgcactccagcctaggcaacaagagcaaaaccctgtctcagaaaaaaataaataaaaaataaaaaaatgagccaggcatggtggtgcgtgcctgtagacccagctacccaggaggctaaggtgggaggaacacctgagcccagaagtcaaggccgcagtgagccatgatctccccactacattccatcttgggtgacagagcaaggccctgtctcaaaaaatttaaaatgaaataaatagtagagtcaacacaactgtgacacgaaacatgccacatgttaagttctggaaatcctagcctgtcattcttgctggatatcctattctaccccagccacccacccccactccagggtccacctggcctgcctgctcagtccactccctccgcatctcctccgagaagcatcttcttacccactggcttttcctgccactcctaagccttaccttttgcaggttcctggagatcctcgcttctcgtagtctttgcaaggatgagccatgttcagaagctctccgttcagtctgcagggatttcaaccttggctgcagattccatcacatggggagctttgccaaagtgctggtgtcctgtctgtatcccagaccagttgaatcaatctgatttaaagtttccgtatcactacaacttagaaccaatgctgaacaccattggttgcagggatatccacatcccaaactaacttctgatgtgatactctgaggcagagatgtgaaaatgctaatttctgttgtgtgaatttcacttttcatgtgtgcaatcaaccctgtaatatgattcatggccacttaatgcaaatcacacagactactgacctgttaaaagctagactctagaaatcaggtaagaaaaatatgagttagtgcactgatattgtagccctcaatcagcttttccagtacaagttttttggaacaatctacaggtacttaaatagcctttaattttaaaagtggtcactgagctgacttttttttttccttcctcacagtggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtttatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacagggacggtttatgagcacacaattatagcttgtttctactttaacaaggtatgctgcctctgtaaattcatgtattcaaaggaaaaagacaccttgcctatattaaaatgtggaactataaaattttttaaaatccaa

SEQ ID NO: 14934 - DNA, 504 bp, Homo sapiens
aggaggtacgtctggcccatgtcccggggtgctcaggtcaccaaaaaagcgagaggcttagactgctggagctcagggagcgtcgtgaagcccgggcaggggctggtggtcatgaaggatgagtcctggccacccctggggccctgctgaagttgcccaggctctagatcccactggtctaagctctgggcaaggtttctggaaagtccttgtgggacccgctgcctccctgtgacctggcagagcccatacagggtttggttctgggcagaaaatccatgatcctgagactgcaggaggcttttcacaaagttctttgtcactcttaggagaagactgagtcagggaaaaggtgaaccctgcagactgtactagaagacaacgcgggagcacagaggagaccaggacccaattcccaggctgtgtgaccttggacacgttacagctcctctctgcatttcagggttttgttttttttttttttgatttttggtttgtttgttt

SEQ ID NO: 14935 - DNA, 101 bp, Homo sapiens; identical to SEQ ID NO: 6685

SEQ ID NO: 14936 - DNA, 2540 bp, Homo sapiens
gggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgtaaggggcaggcagttctctttcctggggctcttggggtttagtgttttagagagaacaacaccaatccctaagagcagcttcccccaaattaacaagatcttagaacataggctgatgcttattcaagacttagtttaactagaggctaaatttctgatttcaaaggcagaacaaaaccaggtgctttcacccctaaaatgaataggacttcacaaagtgaatacgaagtcacaacgcagatgcaaaacaaatgctagaggacactgcccttcacttcctgcatttcaggagacagtaaagggttacagctcctcatcacttcagatatctgttgccatagagaaggagtggtgtgtagtgtgagttttgttaacctcgagtcctcaaggacctgggtttctctcctcaggtcccgggagaaaaatagcattcagcctgcaggttccaacacaccagggcaggtatcatcaccgcagactgcactggaaagaaattcatggcatttcttttatggagttgagagtggtcttggcgttttttgagagatgccgggagattaggggctggggctacccttgcacaaataacccagtattccatgtcaatcatattgtgaaaagccagtcacactgggcatttcaagtgtaacatttgtgtctgaattcacaatgttataatctggttgcaccaacctgatttttatggaagacctacaagtttaaattgtttcctaaattgtaaataattataactaatttaggaaacaattttatatctaaaggggaatgttttggaacaatgaagcatttggacagattgaggaaggccctaaagtagcattctcccacacgggccacatacagacccaagagggaggtggacactgttccttcaatggaagctagtatcatataacaatcatcataataaatgtttataaatacatgttagtagaaataacaatagggtcccctaaaagtcaattttgttatgatcttaacaacaatagtaggttgctaccacttatcactagagagtccctgtgagatattttatatagcactcacaactttacaaaatagatattattgctcaccctttttatagatgagaacacttggactcagggcagtttagtaacttgtcgaaggttaaacagcttatcattgtagagacagaatctgaggccagagctgctggtctggcccacctgttgtgttactagctgcagattttcttaaagtaaaacctttcttccatcacagataacatgtgttgccgggcgtggtggctcacgcctgtaatcccagcactttgggaggccaaggcgggtggatcatgaggtcaggagatggagaccatcctggctaacacggtgaaaccccgtctctactaaaaaaatacaaaaaaatagccgggcatggtggcgggcacctgtagtcccagctactcaggagactgaggcaggagaatggagtgaacctgggaggcggagctggcagtgagccaagatcgcgccacagcactccagcctgggcgacagagctagactccatctcaaaaaaaaaaaaaaaaaaaaaaaaaaacacgtgttagaaaaggctgatgtcaggccaggctcacctttctgagaggttgccccgactcctaatgccacatcaggctggctctctcccacagttagatctaatgggagagaaggtcaggttccaccaggggaggttctgagaccgaacttagtaagaagctattgtaaaggaaacagtaacaggagaaaactgtatggcaaatacatattttctcctgtatcaaagaaatttaaatcattttaagtcactctggacctgtttcttcatctgcaaaacagggaagttatagattagatgatccttatagttccctatatccttaaggttgtgtggttctatttttgaatttaaaagcagcttgcttttacagctcaaccccaggttctgagaggttcaaatagtatgttctggcaaaagggattcaggtaggtgaaattgctaaataaaagcatgctgatggtttgagtagttctccctgaccttgtgtgtgctttataagatcctttagtagtctctactctcgatgtacactggtggggacctcctcccagccagagagtggctccttgccagaccctcacactcatctgtgtcctatgttctggactcaggattgtgtgccagcttcagaggatgctctccatagccgtagaggtggacaggacccccacctgcagctccaataaaattgccgagatgatgtttgggtttgtgctggacattcctgagaggagccagaggtgagtcttgattttgttggggagagcagttatttaaaaaaaaaacaaaaaaaa

SEQ ID NO: 14937 - DNA, 2540 bp, Homo sapiens
gggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgtaaggggcaggcagttctctttcctggggctcttggggtttagtgttttagagagaacaacaccaatccctaagagcagcttcccccaaattaacaagatcttagaacataggctgatgcttattcaagacttagtttaactagaggctaaatttctgatttcaaaggcagaacaaaaccaggtgctttcacccctaaaatgaataggacttcacaaagtgaatacgaagtcacaacgcagatgcaaaacaaatgctagaggacactgcccttcacttcctgcatttcaggagacagtaaagggttacagctcctcatcacttcagatatctgttgccatagagaaggagtggtgtgtagtgtgagttttgttaacctcgagtcctcaaggacctgggtttctctcctcaggtcccgggagaaaaatagcattcagcctgcaggttccaacacaccagggcaggtatcatcaccgcagactgcactggaaagaaattcatggcatttcttttatggagttgagagtggtcttggcgttttttgagagatgccgggagattaggggctggggctacccttgcacaaataacccagtattccatgtcaatcatattgtgaaaagccagtcacactgggcatttcaaatgtaacatttgtgtctgaattcacaatgttataatctggttgcaccaacctgatttttatggaagacctacaagtttaaattgtttcctaaattgtaaataattataactaatttaggaaacaattttatatctaaaggggaatgttttggaacaatgaagcatttggacagattgaggaaggccctaaagtagcattctcccacacgggccacatacagacccaagagggaggtggacactgttccttcaatggaagctagtatcatataacaatcatcataataaatgtttataaatacatgttagtagaaataacaatagggtcccctaaaagtcaattttgttatgatcttaacaacaatagtaggttgctaccacttatcactagagagtccctgtgagatatttcatatagcactcacaactttacaaaatagatattattgctcaccctttttatagatgagaacacttggactcagggcagtttagtaacttgtcgaaggttaaacagcttatcattgtagagacagaatctgaggccagagctgctggtctggcccacctgttgtgttactagctgcagattttcttaaagtaaaacctttcttccatcacagataacatgtgttgccgggcgtggtggctcacgcctgtaatcccagcactttgggaggccaaggcgggtggatcatgaggtcaggagatggagaccatcctggctaacacggtgaaaccccgtctctactaaaaaaatacaaaaaaatagccgggcatggtggcgggcacctgtagtcccagctactcaggagactgaggcaggagaatggagtgaacctgggaggcggagctggcagtgagccaagatcgcgccacagcactccagcctgggcgacagagctagactccatctcaaaaaataaaaataaaaaaaaaaaaaacacgtgttagaaaaggctgatgtcaggccaggctcacctttctgagaggttgccccgactcctaatgccacatcaggctggctctctcccacagttagatctaatgggagagaaggtcaggttccaccaggggaggttctgagaccgaacttagtaagaagctattgtaaaggaaacagtaacaggagaaaactgtatggcaaatacatattttctcctgtatcaaagaaatttaaatcattttaagtcactctggacctgtttcttcatctgcaaaacagggaagttatagattagatgatccttatagttccctatatccttaaggttgtgtggttctatttttgaatttaaaagcagcttgcttttacagctcaaccccaggttctgagaggttcaaatagtatgttctggcaaaagggattcaggtaggtgaaattgctaaataaaagcatgctgatggtttgagtagttctccctgaccttgtgtgtgctttataagatcctttagtagtctctactctcgatgtacactggtggggacctcctcccagccagagagtggctccttgccagaccctcacactcatctgtgtcctatgttctggactcaggattgtgtgccagcttcagaggatgctctccatagccgtagaggtggacaggacccccacctgcagctccaataaaattgccgagatgatgtttgggtttgtgctggacattcctgagaggagccagaggtgagtcttgattttgttggggagagcagttatttaaaaaaaaaacaaaaaaaa

SEQ ID NO: 14938 - DNA, 401 bp, Homo sapiens
cacccaccttgcacccaggtgatcatcattctgcatggtcatcatttcatttctttcctttctatgtagttgtattgcatatacatgtattcctataaaatatatttttttactttagttcctttagctctatattaaaaggtatcatgctatatgtaatctattgagaattttatttttcacttactgttttatagtaccaagatttgtccatattgttgcctgtcactgtagtttatttatattgatagtcatattcatactcatatccttcatttgccttccacctttcaaaatttcactgctatcacctgggaggcggagcttgcagtgagccgagatcgcaccactgcactccagcctggcgacagagcgagactctgcctaaaaaaaaaaaaaaa

SEQ ID NO: 14939 - DNA, 401 bp, Homo sapiens
cacccaccttgcacccaggtgatcatcattctgcatggtcatcatttcatttctttcctttctatgtagttgtattgcatatacatgtattcctataaaatatatttttttactttagttcctttagctctatattaaaaggtatcatgctatatgtaatctattgagaattttatttttcacttactgttttatagtaccaagatttgtccatattgttgcctgtcactgtagtttatttatattgatattcatattcatactcatatccttcatttgccttccacctttcaaaatttcactgctatcacctgggaggcggagcttgcagtgagccgagatcgcaccactgcactccagcctggcgacagagcgagactctgcctaaaaaaaaaaaaaaa

SEQ ID NO: 14940 - DNA, 3992 bp, Homo sapiens
tcccagcactttgggagaccaaggcgggcggatcacgaggtcaggagatcgagaccatcctggctaatgcgatgaaaccccgtctctactaaaaatacaaaaaaattagccgggtgtggtggtaggcgcctgtagtcccagctactcaggaggctgaggcaggagaatggtgtgaaccctggaggcggagcttgcagtgagctgagatggcgccactgcactctagcctgggtgacagagcgagactccgtctcaaaaaataaataagaaattaattacttaattaattaaataaataataaaaataaaaatttaactgttaagccctgccttcttctcttatctttatccataggcctggcataagtgttcactaaaggcttggtgggtgaatgaaatagatatatccaatattagaggaactagaggtgacacaagaatgaaaagagttggacctatagaatgaccccagatagtaagaattaggaattcagtttctctaagcatgaattagtgaagtatttcattaggaagggataaagaaatggtttttggctaaaaacaatgattccttccttgacccagtaattttaaaatccagaggaagaaaactaaactagaatgaatatgaattcatgaacaattgctggtacaggaaataagtataagagagtcattgcgtagtggtgacccttggggaaattatggtatatgtttgtcttcagtgcatctccaccagctccatgcgtgcttcccatccccatccctaaactcccagctgacaaccaagacaactattgtgcagctttggtttcttctattacaagaaaatgtcatgccaaatagtactggaataggacttaattaaaatactctggtaagattgagacatttactgagtccctacaatgtgccagccattgtcacattaattatctcatttgttttctgttttttttttctttttctttttctttataatttagaaacagggtcttgctatgttgcccaggctagttttgaactcctgggctcaagcaatcctcctgcctcagcctcccgaagttctgggattacaggcatgagccaccgcacccaaccttatttatttttcttataatgttatccctatttatttatttatttgttttgaggcagagtctcactctgtcacccaggctggagtacagtggtgggatctcagctcactgcaatctttgcctcctgggttcaagtgattctcctgccttagcctcctgagtggctgggattacaggtgcatgcccctatacccagctaatttgtgtatttttagtagagatggggtttcaccatgttagccaggctggtctcaaactcctgacctcaggtgatctgcccaccgcagtctcccaaagtgctgggattacaggcgtaaaccaccacacctggcaatgttatctctatttaatgaataagaaaagcattcaaagaggtggagttaactagcctaagtttatgtagctaatcaggttcagaatccaaatttaaacccagggctgcttaatcccaaattcaatattcaaaggaggcagtgtgttgtactggtcagacagaagaaagtgcacatgaataccatgcttgctctaacactttgtcaggagtatttcatttgggtccaactcctctactattcattcatgtaagcccagatgctggtaagaaatgggaaagctaaggaataggtaacaaaaaaaaattaggaattaaaacagacaaacatgatttatacaaaacctggccctactttaaaattctctcagaggggcaaattggccactcacccaaattatgctaaaagatactttacttggcctttaccttgatttattttaattttctaaagattaagtataatttacatacaattaaattatgtaaactagcttgcatacataccatccagtgagtcttgacaaatgcatataccttcttgacctatcattttccaattgctcattagtagtgtatagaaaccctgcaaccttaataaattaacttattctagtaggatttttgtttgttttccttaggattctctacatacacaatcacgttgtctaaaaatacactttaactgtatccttcccaatctgtgtatgccttttgcttgctttttcttgccatactgcataggctagaatctccaggaaaatgttggagaagcagtgagagtagacattattgccccattcctgatcttagggtgaaaacattcagtttttgactattaagtgtgatgttagctataaatgtttcataggtgccctttgtcagtttgagggagcttccttccatttctagtgtattatttttacgaagaataagtattgaaatttgccaaatatgttgtctccatctattgagataatcatagtttttcttctttattctgttgatgtggtgtaatacactgattaatttactcacgttaaaccaactttgcattcctggaataaaaaccctacttggttgtgatgttatccttcttatatattgatggattcaagttgctaatattttgttaaggatttttgcatcaatgtttacaagggatattgacctgtagttttattttcctgtaatgtttaatgttttccatgtttccttatgcatatttaaaagaaagataagttggccaggctggtctcgaactcctgacctcagatgatctgcccacctcagcctcccaagatgctgggattacaggtgtgagccaccaggcccagccttatgaactgaattctaaaataagtttaaaaagcaaaatgcaaaataatattatattaaatatacatatctttttgtaaaaaaatgataaaaatatacatgattctgatcatttgtttaaaaaagaaacaaagttaaggtaagccacagactaataaaattgcttacatacagagagtgggtgggaatgggataaaaaggagaaaaggtactgggctcggtggtaatggtggcagtggtggtggtggtggtaaacacttccctgagtatgcctttttgtgtggctgtaaacactttttagagtcatgttaacccatttatgcctggggttcaacattttttgtgtgaaaaatcagacctgggcaatgaccttgagcagtaggatacaaataactctcacaagtttagcgttccaataatggaacactgggcataaatttaatgttttacatactcaaaaaatcaagttcacagggtgccaaaaatggaatacaaacagaaacaagttaacctaactgtattttaataaaataaaggagagctagcatggtggcatgcacccacagttccaactactcaggaggctccagtaggaggatcacttgagcacaggcgtatgaggctggcctgggcaacacagcaaatcctgttggtaattaatcaataaaaatggaaggggtggagggacaggcccaggtaacttttttttaaccttttatttttattttattttaaaaaattgtagattcacaggaaattgcaaaacctattagaagtagtgtatatcctttacactgttttcccctagatacaaggggaactataactatagtacaatatcacaaataggaaatttacattggtacaatcccagactttattcagttctacccattctcatgcactcatttgtgtgaagctctttttagttctattacctgtgtagatttttatgaccgtcaccgcagtcaagatgtataactgttctggccgggcgcgggggctcacgcctgtaatcccagcactttgggaggccgagactggcggatcacgaggtcaggagatcaagaccatcctggctaacacggtgaaaccccgtctcttctaaaaatacaaaaaattagccgggtgcggtggcgggcgcctgtagtcccagctactcgggaggctgaggcaggagaatggcgtgaacccgggaggcggagcttgcagtgagcagagat

SEQ ID NO: 14941 - DNA, 84 bp, Homo sapiens; identical to SEQ ID NO: 13656

SEQ ID NO: 14942 - DNA, 766 bp, Homo sapiens
agaccattgagcctggcatatagtactcaataaatacttgttgaataaataaatgaatagcgactgtgatagggtaataataaaatagtaataatcactacctgtgttaagggcttactcttatgctagacactgttccaaatcctttccatgtttatgtttctccttttagtaggattgtgtttatttccattaaacatcaccaagaaaaacaaaaagaaatcctgtattaacatttgctgcatttctaaatgacattctggccaaaaactatagtttatcttgacgtagatgatttttgcaatcaagacaagttatcactcaaagaccactccaatttattgtccaatcctctggtaacaaatgtggtcagtaggagttcttatacctggcagatagacaagggcaatggttttcaaacttttatctcaagaactcattatacccataaaaactattgaagatcctgggctgggcgtggtggctcactcctgtaatcccagcactttgggaggctgaggcaggcggatcacttgaggtcaggagttcgagaccagcctggccaacatggtggaacctcgtctctactaaaaataaaaaattagttgggcatggtggcacatgcctgtaattccagctactcgggaggctgaggcaggagaatcgcttgaacctgggaggcagaggttgcaggagccgagatcgtgccactgcactccagcctgggcaacagagcaagaccctgtctcaaaaaaaaaaaaaaaaa

SEQ ID NO: 14943 - DNA, 520 bp, Homo sapiens
gttgcacattttcgttctgactctcttgtggagttctcttacagccgttgtctttagtcatccctcccccacccggagctgcgacaatggcgttgcccaggaaacgttgcgcttccaggccgctgacatccagggaatgaagtcttgcgtcacaaggggagcgacggccttgtgcacgcgctctgtgcggcctgagtaatctgtcggccctgagtaccaccaggggcttttgaatctttgccaagggagaatggggaagattttgcaacttatcaataacctattagctaatgttgctggggaggatcttcgactttgtgtgattattgtgctaaagtttcaattaatcaccaggccctgtggccctacttccaaaatactatacatcccaaattcatccactgttttgtgtctctacctgccattatcctgttccaggctcccagcatctttcactgggatactgccgtaaccctgtaaatagtctccctgcttgtcacccttgccccactacactcca

SEQ ID NO: 14944 - DNA, 6271 bp, Homo sapiens
aggatgctcacaactgtattcctgagctggacagtgagacagccatgttttctgtctacgatggacatggaggtaactttaacagatcatattggtaacattctaggaccccaattccagacgttccagggcaagaacaggtccctttgttcatttactttccagggtctggccctcattatcatttcctgcgtggtgctgtttttctgtattctgtcattcttttttcccagtaggtactgtattggtttataatctcaccaggacttgttttaatccaaagagcctctatctttttttatttttattttttaaaatttttaggctgggcacgcggtaggtcacacctgtaatcccggcacagtggatcacgaggtcaggagttcgagaccagcctgaccaatatggtgaaaccccatctctactaaaaatacaaaaattagctgggcgtagtggtgggcgcctgtggtcccagctgctcggaaggctgaggcaggagaatcgcttgaacctgggaggtggaggttgcagtgagccaagaccatgccactgcactccagcctgggcaacagagcaagactcttgtcttaaaaaacaaaaaagtgtacccagttgagctgattctttatctttttttcactggagaactaagtatacaggtgagaaaagacgagatatttatacccgagagaattgatggtgaaatccatttttttggatcagaacttccccaaacagtgtccttcaaatagggttcaggggtgctaagatatttatcccctcaacccttggggttcactccagtatggcatataaatattgtatcactttctatgtgtggggagcagtgctccaggtgaccttccttcctttccttctaggggaggaagttgccttgtactgtgccaaatatcttcctgatatcatcaaagatcagaaggcctacaaggaaggcaagctacagaaggtctgtctgcttacaccgcccattcctcacttgtgtaggcttttcccttgttctctagcccttgggcttttcctttctttttgtcctctagctgctgctgcttatttactcttgaagaattctgttcctaaaacgagcttattggccgccttttagacttgccttattattcctaggcctctgagctgtttttatctgtgagtgtctcttagtgtggtggctcacactcttaatttgtattccatccttgtgctcaggattgtatatagggagttcattttgtactagtcttagactattttgcttatattcaggctttagaagatgccttcttggctattgacgccaaattgaccactgaagaagtcattaaagagctggcacagattgcagggcgacccactgaggatgaagatgaaaaagaaaaagtagctgatgaagatgatggtgagtgtggcatcccttgtttgaggggaaatcagcattttaagaaatattctttaatattacttatcaattctaagataggatggctttctagggacctggggagtccttatgttaaagaaacctatgatgttctcctgcattgtatgtggttatgaaaaggagggagagaattatcttcgttgagtggcatctgagctgtaagcattgtatatacattatcttttgtcattgtgatggggtcttcctggttcctgctagtatttatgtgcttttttttcccctcaagactggagcagttattagccccaatagccaatcattaagcctaaatcctaattcacagtagcattgtgggcttcctggatcctcagccagaatagggtttttacaacttaacaataaaaaatgagacgtcagaggggaagtatagtaactagtgttgttttgattaagaaggggatgaaacacaaaaaccaaaagaagtctgtggaggaggaggagctagggcatgttcttctgagacttgagcgagaggaaccttgggagtgggaggttgtggggaagttagaggctgcaagggctgttgaggtagtgagagggacggatcccatgaggagtctggcatgggggctctgatttagcctcttccctgcagtggacaatgaggaggctgcactgctgcatgaagaggctaccatgactattgaagagctgctgacacgctacgggcagaactgtcacaagggccctccccacagcaaatctggaggtgggacaggcgaggaaccagggtcccagggcctcaatggggaggcaggacctgaggactcaactagggaaactccttcacaagaaaatggccccacagccaaggcctacacaggcttttcctccaactcggaacgtgggactgaggcaggccaagttggtgagcctggcattcccactggtgaggctgggccttcctgctcttcagcctctgacaagctgcctcgagttgctaagtccaagttctttgaggacagtgaggatgagtcagatgaggcggaggaagaagaggaagacagtgaggtaagggcctgtgagggcaggcagatgctgaagttgcagagaggtcctgtttggttgccgtctgtagttttcaactctctttccttctcctattttgacatcatcccccaagacccactgtattctaagctttagtcttgaattcattgagctccatcatcacaggtaccatttgcctttttacctcttcctttgttggtactataacaagcagatctagttctggcttttcagagtctgtctcctagagagagaacaaggagatagttgttaccttggctagttgactgttttcttctctggaaaatttattttctggccacagtgcctgaaagatatttttggctggcagcccttgccttgtcctgggctttttgctagtgactgctaagcccagttcaggatgtcagttgtactcatgctagccctttccatccccccaattttcatgaccatatacttgtatctttcagtgttttgaggacctgtgttcagtcaggacctcttgattctgagtatgagctgtggggagggaggggatcatcccagtctcagcagtctgggatcctccccctggcaggaatgcagcgaggaagaggatggctacagcagtgaggaggcagagaatgaggaagatgaggatgacaccgaggaggctgaagaggacgatgaagaagaagaagaagagatgatggtgccagggatggaaggcaaagaggaggtgtgtggggaaggggagcaatgagtcttgaaaagccacaaggcaggtgtgaatcccctaattttgattttgagacagggatccccctgatactttaggatggaagtaatagtcatggggatttattctgcaaggggaatgagatggtaagcctttggggttgaattatctaaaaacaagggagagggagtgtgctgctgtctctagaaagatgaaatgtgtgcttctcctgtttgttaaagctcttttgggggtcccagtgaaagcaagcataggtgaacgatcaggagcacatcagtgaggaacgcatgttcagaagcccccatgatgctccttttcttcctcttaagcctggctctgacagtggtacaacagcggtggtggccctgatacgagggaagcagttgattgtagccaacgcaggagactctcgctgtgtggtatctgaggctggcaaagctttagacatgtcctatgatcacaaaccagaggatgaagtagaactagcacgcatcaagaatgctggtggcaaggtcaccatggatgggcgagtcaacgggggcctcaacctctccagagccattggtaagggccaagaaactgggaaagacttctagggtctttctctctgtcccagactacctagtagcaaactttaatcttcctagtgcttgtgcctttcaaagcactttaatatctactacctctgttcttatatttctgtgaaataactaagatgggtagaggtatcattatacataggtatcattatacccatcttatgtaacatttgaatgatgaaaaagacctgtgagtgccgggcgtggtggctcacgcctgtaatcccagcactttgggaggctgaggctggtggatcgcctgaggtcaggagttcgaggccagcctggccaacatggtgaaaccccatctctactaaaaaaaaaaaaaaatacaaaaattagctgggcatggtagtgcaagcctgtaatcccagctactcaggaggctgaggcaggagaaccgcttgaatccgggaggcggaggttgtagtgagccgagatcgtgccattacactccagcctgggctacaagagtgaaactccgtctcaaaaaaaaaaaaacaaaaaagacttaaaataaaaagaccagtgagtgactttcttaaggttcagcagtctggtggcagggttgaaactagaaaaactaggacttaggactcagttccccattccactagattatggaactttgtaaagaagggaaatgaatggcaaggtttgacctgccacaaacacaagtctgtgggaagtatccaaactgctcatcaaccattcctttactccaggggaccacttctataagagaaacaagaacctgccacctgaggaacagatgatttcagcccttcctgacatcaaggtgctgactctcactgacgaccatgaattcatggtcattgcctgtgatggcatctggtgagcactggcagaatgccctaaattcccctttctgcagcatgtcttctcttataggactcagggcacctctaggattagagcctaggcagacctaggcctcttggtgggtgaagagcacccagactaaggcagagctgagaatttctgtagttatttacactggcctgggccaccacctctgtccatactcctctacgctgccttagtgagactggaagattctgactgttgttcttgaccccaggaatgtgatgagcagccaggaagttgtagatttcattcaatcaaagatcagccagcgtgatgaaaatggggagcttcggttattgtcatccattgtggaagaggtgagtaccagggtggagaagagagggtgtctggtctgcacagccagggttcactcttttaatctgagctaagtcggcaatctgggagcattatcagtaattgctgacagacgctaaaccccgactccaaagttccaccttctgtcatttccctgacttagccttatgccttatggactagcaggtgggccgttgtgtgatacctcttgcccattcctctcctaccaccctgactcagcaagccagccctcttgtgggactgtagattcctggcaaggtgttcaaaccctgtggctgagctacccccatccctttcttagctgctggatcagtgcctggcaccagacacttctggggatggtacagggtgtgacaacatgacctgcatcatcatttgcttcaagccccgaaacacagcagagctccagccagagagtggcaagcgaaaactagaggaggtgctctctactgagggggctgaagaaaatggcaacagcgacaagaagaagaaggccaagcgagactagcagtcatccagacccctgcccacctagactgttttctgagccctccggacctgagactgagttttgtctttttcctttagccttagcagtgggtatgaggtgtgcagggggagctgggtggcttcactccgcccattccaaagagggctctccctccacactgcagccgggagcctctgctgtccttcccagccgcctctgctcctcgggctcatcaccggttctgtgcctgtgctctgttgtgttggagggaaggactggcggttctggtttttactctgtgaactttatttaaggacattcttttttattggcggctccatggccctcggccgcttgcacccgctctctgttgtacactttcaatcaacactttttcagactaaaggccaaaacctaatcgtacgcatcgtgtccttttttttctgctgccgtggcccccgacttggtcccatctgtagcatgtggcgagcccccatgtgagtgtgtgcgtgtgctcgtgtgtgtcctgcgcgtgtataggagagcccagagcgagctgctggtaggccggcctggcgggcgtcgcggctgcccctcgccccctcctgcagccagaaatgatctagttcccccagggacaggttgggaccggtctggctggcctgaagcctggagtcgggcaggacgcctcctgcgctgctccctggccggctccccgctgccgctga

SEQ ID NO: 14945 - DNA, 9266 bp, Homo sapiens
gcggccgcagccggaggcgcgtcggctggagccggtcacgatgccccgaaggaagcaaagccacccgcagcccgtgaaatgcgagggggtcaaaggtcaggggtcaggggccttgaggggagaggagcgggggtggggtcagtggagtgggctcaggtcagggtggagggggactcctgagggatgaagtgggcgatccagactcctagcttcccaccgaggcactaagggaatcagagtgggtcagcgagtacgggaagtgtggtccacgagggctggttcctgagggagaatccacaagccccctcccctcttcagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggtgggttttcgggtcttggttaaggattagcggccgctggagaccccagcccttcaggaggcaggttaggtgaacagaacaccatttcctgccacaaccgagggctggtttagtttacatttgagctagatgacttcatttgtttaatggtccaatcacttccatcactttgttgaggtgaagttctgaggcctggtcaaaggtgataggaataggagggtgggtgaatcacatggagcaactgattaaaagtaaatgccctgtctctctccctagcccattccttatgtgtatttacttttaagagaggttcagggaagcaaactctctgtaaatcattcaacccagtatttaggtctaatctaactccctttcacctgcagcgtaagctccttttgtattgagaggttttagtttctgtctttatccttccatgtccctcttccctgtgatcttagcatcaccctaccctaatttgctgcactacccatccacttatgcaagatgttttttgaaagtcattgaggggatccatgtaaatatctgttctttaggcaggcaagtggtattacatgcattactttcattgtctccacttccctccaaattttgcctcagagataggttttattttatatcagctccttactaaaaggggccttagcaatagagcttagaaaaaggtcttgggggctctctccctttcgtatttttactttcttgtctcaagaattaatttcattatggattcatttcagtctgtgatccactgtgagcccttgatccttgaccattgagggaaactagatacaggtcaattctaccatcactagattagtccagtgtaagaggtagacaattcatgttgaattttctggaattactgcaggggagaccttgattcctaggagggaactaaagggatcatcaaagctaagggtggagccaagcaagtggggagaccataagtgaaaaggggagagtttggagcctgatcctaccctatgctgatgtctcttcttatgtctatttcaccaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcgggccccggcgacctgaaggtaagacacaccagggaccaaagatcttgggacatgggtggctgaccctaggaatgcttggattggattcatagcccaggtctttgtccccacagatgctctgctccttccagatttgagcctccatgtgccaccaggtgtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggcccacacgctgtacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaagccatgtctatgctgaattggcaatggcaggcaatttggccttacccttagcatagtagtccatgctgtgatgggggaagcaggggcagtgagagggaaccagaggtaggcagcagtcaggctgagtttaatgatggggaactgggccagaccaaacacagacctctgcccatccccttggcctttgcgatggctccaagaggccagaagcggccagaggagatatggttcctccccaaggcaggcagccatggtcccttagactttgtgcaaaatactaaatgctaatttggcatcgagggccagctctgaaaagagaaggggcaatcctctgtgcagccagcccaggggacaaggaaaggtaggatacgaggcccctggccaagagaaaaggggtaggtaggaaagaagaaggaaaagacccctccgcccctagcatgggggacacaggcacagggcaagtttctgtaaattcctctggggtagagggcagacatccaagcagtggagattacagatcctcatctccaatgccctcgaaggcgaaattgccgtggacatcactggcactggcatctgtgctgggactgccaattccccgcaagctcacggcactcagcttactctgtaacaaaggcagggtggggtcagagatcttgggcgtgcaagatcccccaacaaacagcaacctcaccaacgctggaactcactgagagtttgaccatagactcccgggtggcatcaggtgactcctggggaagaagaggcagaggtgtcagaaactcactaggagaggtgaggcagggctgagagccagggttctgaccaggaggtaatacttacaagcagtggtggggacttcactgcttgctggctgtctgagcgtctcagagtaccccccacccgccggcgcagcatctggggacagacacaaggtgccggtgagggcaggatcacttcccctccctctcaagacaagcctcacatctaggacaaaaggcaaggggagcacacctgctcactgctcagtccacacttgctgcctaccttcctgatactgccgccagatttcttcaccatcagttcatcaaccatggactgcaagcagatgctcatcatgatagcctgagggcaagaagagtgtccagcttgatgagagtggtcactctgagcccagcaccactaatgcctcccatattgagtactggaaactctacactttaaggtgctccagaggagggctgagggtaggttcacacctgggggctagtgatggtgacccactgtagccggtccttgctcatgaggtattcaaaagccagttccaggcgcacctcaccccggccccggcctgggctgctcgtgcttccactgggcaatggtacctgggagaggaaggggaattcggttgagttcactctgaccaacctgtctggctccctgacccgctgcagcccatacctaagctcaaggcttgccgggcccccaacccaggcccttccccctcctaacccgactcacagaggaggtgacccgccagcatcgcatgcgggtgacccggaaggagccttctcggagttgctggccaggcaggcggagctgcaggctgagctcactgttgcccgcgctcaccaccacaggacagtccttttctgggaagtcagccacacaggcatcaaagcgcaagtagccatagtgccgcagcgtctgggccagtctcaggaactgaaaaatggtcatcacatgggggtagattaggagggagaatggggcagctcagaaaaagcaaccccggtcgggcgcggtggctcatgcctataatcccagcactttaggaggcagaggcagacagatcacaaggtcaggagctcaagaccatcctggctaacatggtgaaaccctgtctctcccaaaaatacaaaaaattagccgggcgtcgtggcgggtgcctgtagtcccagctactcgggaggctgaggcgggagaatggcatgaatctgagaggcagagcttgcagtgagccaagatcgcgccactgcaagcccttagaggaagacagagaggaggcagggctcacctccttcttggagactttctcttgcagagatttgagttgccggtgctgttccttggtgaccaagatccacccacgctcaatatctgataccgtctatagtagagacaaggggcaggcagtaggaggtcccagtcagcaatccaaggaaagcgtctaccattacctctgtccagcctgacccctagccccacacttgagcgacctctctgcagtaagtccttgatcttgtcagcttaataaaagtagggagagtagatattgtgccagcagcactgatagtattctaggaacttccccacaaattgggaacaaagacacgacagcagttttcttgggagagtgagtcacccgttattttcttcaggggaagggttctgaggcagctccaagctcacctgagcataaagcaggttcaggccaacccggttctccatgacatcgtcatcataggcagagtcccaataactgtgaggccaaggggtggaaaggggtaatggggctaagctgggttaaggcaagaggtagaatggaaaatgggcaaaacaggagcaatctggaactatcaggggctaatggtatagtgggaggaagcttgggaggcctggcagaaacacccagcactacacccccttgtccagattattctgtctcaatatgtggcccaataatccaatccagcacagcacctcccacccctccccttccaggcccagccctgacctcttccttagcacaatcttatactcttgactccgaaggctggtgacagacacataaggcagctcaaactcttgcaacttccgtacaactacaggttaaaaaaaaaaaaatgaaaatatagtgagatttaaaggaagggaaatcaagaaagaagtgccctgaggcaatgttcattctgggggtgggggtggggagttaggggggctgcaaactctactgaagtacccttgtactgcagtcaagtccagagaaactcacaagaaaaggctccatcctctttttctcgaactaagaatagactaaagtatccaatcaagtcatctggaagatccagctttgcagctacagcctggggatagggatagaagtacagctcatcatactggctggttccaatcattctccaagcccaggaccccaggatgtaggggaagaaggggcagtgctgaacaagcgcctcacctccaggacatcctcagtctgatctgaagttagcacgttgaccagaactttctgcccgttgctgagcagcacttccaaggacacttcctctgtggggacctgctgtgtctcctgttgtgagcacacatggggatgggaagcactgccttgtcccttgccttgacctatgcccaactctatttctaggtcccttgtgtgtctttattctcagctgcttaaatataggctgtgatttctttgatttcataagaatagaagttccattccattaaaaaagatgactcctctgttattaagatgacatggcctggctgggtgtggtggctcacacccgtaatcccagcactttgggaggccaaggcgggtggatcacctgaggtcaggagttcgagaccagccaggccaacacggcaaaaccccgtctccactaaaaatacaaaaatgagccggacatggtggcaggcgcctgtaattctagctacttgggaggctgaggcaggagaatcgcttgaatccgggaggcggagattgcagtgagctgagatcgcaccactgcactccagcctgtgcaaaagagcaagactctgtctcaaaaaaataaaagacatgaccttccagcaaggtcctttccttaaatcttggtcccacccaaagccctacctgttgtgcccgacgcaggaaactgttgaaagtctcgctgctcccaagcaatgggtcttgccgaactacgaggacaagagaacattattacaggaacttagcactcactcttggctccccagtcctcctctcagtaggttcccccgaccccatttcctgggctgatggtggcctgccacatcccccagctggcctcacctcactcactgtttgcataaattcttcacctgccccacccttggctgccatctaggtgagtccagtctatagaactagggaaataacaatgatgttaatctaaagcacatcagatacaaattaagttctctccactgatattaagactagtgttatactagtatttctcatagatgttagtgcccaaattgttttgctagtacacagagttacacatcctcgtacactatttactttgctaactgcataacagatcaaacaagagccttcctagatctagaaattaaatcaggcccttccacagaaccagctgtttttaagtctctccccatagtcctcaatatagtcaacctagtttcctgcaaccactcaccagcttgcatgtacttctctaactgctctctcctctgttctacctcagcaggagtcagagagaaaagcttctttggggggaatgcaggaagcacattggccccatactccttccgaagctatttagagaaagagatacaacccttcacataaacacagaaaatgagatgaggcaatctacatatgctcataatgttctcttgggtgcccctcccttccctcagtccctgttcccctgtctaccctggtcatctgagaaacaattcctttgacagcggtagcacctcaagggagctgtcctagatataagttgtgctctattttactgtgtacaagtcagcccctccacagtacggggaggatttgtactgggccaggacctatagggagccccttgaccacctagcaagactgttcactgaacccttaaaggaaggaaagggctttataaagtgcacagttaatagctaagtctgttcacaaaatatcttaggacttaaagggactttgcagatcaaagaatccatctttcagttgtagaaactgaggcccaaagaaatcagtttctacaggcctcatgcctgtaatctcagcattttgggaggcaaggtgggtggatcacctgaggtcaggagtttgagaccagcctggccaacatagtgaaacccctctctactaaaaatacaaaaattagctgggtgtggcggcagccgcctgtaatcccagctactcaggaggctgaggaaggagaatcgcttgaacccaggaggcagaggttgcagtgagccgagatgtgccactgcactccagcctgggcaacaagagagaaactccgtcccaaaaaaagatatcaggtaacttgttcagggttgcacaactaattatcagtggagctctactgagttaaatagagtttaagatctggtaaggaaggaggagaaacattgcatcacagatacataacgataattggcacagctaaacacactgaaatgagccgaagaacacaaaaggaaatcggtgaatcgtttgtataagcagggaaaagaatttcaagttgccgctcagatgacagaaggaatgtgctttgacagcctgggtggaggtagtggggggaggggttggtttgtccatgcaggggtaaaggctactagagcagtaagactggacagaaaaccagaatataagaacaggaaggagcagttgttgcgcggacattaagcttcttagggagttcccggaaatgtcagacaagataaaccagggccctaccctgtggcagtgattaaaggggaactacagcctacgggaacaagaagagcgggtaaagggagacactgatgtccacgtgtagggaagggcttgaagctgtctcaaggcaggggtgctagtcccacctgctcgtgcagccccaggagctggctgtagcgcacccgacagtgcaggactcca

SEQ ID NO: 14946 - DNA, 27289 bp, Homo sapiens
aacgctgtccaactgggcgtacgagtttgacaagtgggccccctccgtggtgaaggtgtcttacaaggtaggtcacagccactgaggtttcctctcttgctacggaggtgcaggcggtggtgggcaggacgtccacacatacctctggacagtgaacctgagaatgctgggtctccagtcgcatggagtctccaggacagcctggaactccagtcacatggatccgggagtttggactgggcagggacagggcagattagctcactggggaggagacaggagtgagcatggtggccagcactcagaggccagctcaggcgcctgagatggggacccaggaagaggggagcctgtcagccaccaggaatgtgcagatggcggtgcaggctgcgtggttccctcaggccccggccgccgctggcctgcactgcttcctcttccccctgcagcgcgtgttctgcgtggtgaggtctggggacgcgccagcggccctgccagcccctttccccactacccctgtgaggacgagccctcccgccgtgtcactgggcagttgcagggggtgcctgtgcccctcttgccacctggccacccggctccaaaagccgagctgtgcatcctgcttcccttgcagggatccccagcagcaagacgggcctttgtcccccagctccggagtgggaagttcaacgtcttgctgacgacgtacgagtacatcatcaaagacaagcacatcctcgccaaggtaacgtgtccctgtgggaaatgccaggccatgggccgagtgctcacacgtgggtcacgctgcccgtctcctccaaagcccctacaagtttcttcccggagtcccacctgcatgtgcgtgaagacagctgccctgtgtaggggaaaggcctaggtgggggcgacctcaggtttacctccctaactgtctccaggcaggccctgagtcaggcccagaagctggggccatctacacagcatgcgctctgcctcctctcgggccttctgcccagagagcctcagcaccaaggcgtctcctgacccgcctacagagtccccatggggccttggccagaccagtcttgtcctcctgtctcattgccttggccgtccctccctggggccctggcttctcaccacaggccatgggctgagattcagcatgtgggggagagctcgagggccaaataccatgactgcctgctggccttgggcagctggttcgggctgttctgtgagggtcctactgtcctggaagcctcttctgggacgaaactgtgaagggagtcccagcgtggccatgactgagaatacggcccagatagaaaacagacatagccctctgcctccaaaaactcatgttcctcatttgaggaggggtaaagatgtacctggtctcacccctaaacatccagctgagtgagtgttgaacagtagagagttttttgcgttttggtttttttttttttgagaccgagtctcgctctgttgcccatgctggagtgcagtgatgtgatcacagctcactgcaggcctgacctcctggcctcaagcgatcctcccacctcaccctcctgagtagctgggactacaggtgtgcgccaccactcccagctaacttttttaaatttattttttatggagatggggtcttgctgtactgcccaggctggtctcaaactcctggcctcaaggaatcctctcgccttggcctcacaaagcactgggcaactgtgtctggcctaacagtagagttcttgacccaggtatggggggatggaggagctgtttatgggtggctccgcctctcagtgcatggctggagtgacagtactggaatactggggctgtgaactgggtgttttcttttctttttctcttcttttttttttttattgagacagagtctcacagctgtcacccaggctggagtgcagtggagcgatctcagctcactgcaacaacctctgcctcctgggttcaagtgattctcctgcctcagccttccgaggactgggtgctttatcccggagccaacaagggaggaaactgaggcccagggagctgggtatcccacgtgcaggctcttacctcaggtccatgcttcaggtgcctcctttgtggctcacccctgctgactccttacaaagccaggccgttggcaggcacaggaaccaggctctgaaaccccgtgctcccctgccagtggctcagttgatgtaatcaccctgcagtgggagtgctctttgagtgcggccactgcgccccctcccgacccgcatggccctgtatgtagtggcgctggcccctaccccatggggcccacattctgaaccacaggctgctcattagaaatgtaccgtcaccaacccagttcccctgagaccctccacaccagcaggacaagtcccccagtcagcaagatgtgtcttctgccagaacgtgctcggcatttttctgtgctgtagattcatatgtgtgattttgcagggaagccagattgcttttttgcaatttgcattgttcacctgccaatagtcatggggtcacgggcctgtctctgcccaaggcttgcaagaggctacgttgtgtggctccaactcggtgagtcagccccggggcaggacgtcaggcctgtgctctccacccagctgcgctcttccacctggagccttcctggctgctgggcgcagagtgggagattctccccatgtgccgggccacctgctgccccctgccctgattgcccactctggggcccgcagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtgggtttgcccagctgtgcccatgctgacggttccaggtgcggctggctttgctggttggaacgtgttgagcaccagctacagctggctgggcctgtgctgggtgcctggtgagagtctgcatctgcatggagcaggggagccctggaacccaaggctggggcagccacaagggccccaggggagcagggcagaggtcatggtggtgaatctcggaatgctcggggcgtctctgaccctatgctccaggtgcagagtggatggtgaggaagatggccctgaggcagctgtgggaccgcaagcgtgtggagagcacagctagaggctgtagcgtgctgtaggcccctttaggtgccctcagaactcaccctcagggcagtgggaaggaaacttggaagattccagttagcggggccacatggtcaggttctgtcttacgttgttttcaaaaagctcagtggccagtgtgtctcaatgtctgggtggcaccatcagccagactgtggcatggcagcatcatcattgatgagtggtcccacaccagcactgatccctgagcctagagctccttgctgttggaggttgaaactgtgggacagactgtgtttcctgctgaggggtttaagtaaccagatgctgaagtgtgggcagaactacagaggttacctcgaagtgccctgcccagcacggctgggcccacccccttcttcccaccttagacaggtccagggcagctggggccttcctggcctcatgcgtgagttccctgccctctcggctgctggtcaaggcagagactcttctgatggcgaaaccgaggcattccccaaagcctcgtgataaaggagtccccaatttttagactcccgggacccccacactaagggccaggatctgatgctatagttttgtcactttctgagccgagcaaaagctctgccaaaggattgccagggaagcaatagaagaaaagttttggcgtcgtctcattttcctttaacttttttaattaaaacattttaaaagttaattattagtagaggagtaggcgccgtgggaggtcagggtttctttcacctggttccacccaggctgaatgagagtcccttggggctcccggtggcagagccctccctgagaatcacccgctataagccccatgtggtcagcctggcccctgcagcgctcctggcatgagcttggcgtggggtgggtctgtggacactccagtttgtgttactcgtggagaagcagcatgcccgctgccgggggtctttctggtgaggcacagggagcagagtgctctgggtactgcggttccatgtcccaggaattacatggagggaaccagatcctcacagtttcctaaggaagagggtgccctgcctggctcccagaaagcataaagcaggctgaaaagccacgtgccaagggcaagatcaccccaggggaccccgtccaccctgtccccacatccgcaccttctagtgagacctctgtcgccctcctttggaggtaacgcttgcttctcctgtcttgggggcttccaggtggacctgaatgaggaggaaaccattctcatcatccggcgtctccacaaagtgctgcggcccttcttgctccgacgactcaagaaggaagtcgaggcccagttgcccgaaaaggtgatggagttttgaggggagccaccagtgaagcagcctcacgtgggggctttctccagggctgggcgtgctcagggcctctccccacagtcccaggcctgccctggtcaatccagcttgggggtggcgatgacgccactgggtctgtaaagccctgtgctgctgttgtagggattgaaaagcactcataggctcacatagctcacaataggttagagcacaaaatcccacttcctgtcagggggccaggtgcctgtgcgggctctcctggccacatcaggaggggccgtgggcttggggttgccccccggccccccatcatggctctgggttttcaaggcctgctgcagccacacccctgggcccagttcccacagcaagacccatggactcggggtccccggctgcagttgtccctcttggctctttgtttcctggctggctgtagagaggcccccagaagatggctggggggccctttctggcccagtaaccctctggtatctctgcctggtgcttcctctcattgcccaggtctcccctcttctccccagctgtgagggtctcctcacccacaccccagtgtgctctggtcagagctcatatgacagggccgagggggtcagagctgggttcggatggggggagtcaggcctcaagccaccttgggccctcgtgagcattatgtgtcccctgcaggtggagtacgtcatcaagtgcgacatgtctgcgctgcagcgagtgctctaccgccacatgcaggccaagggcgtgctgctgactgatggctccgagaaggacaagaaggtgggccccagagtcccccaactgcattccccactgggtgtccaaggccggcagcgtggcaggcagagcagagcgtgctctgaccatcgggtcatgatctggtcatgatccccagggcatctggccagccctggttatgatggctggtggcttgtgtcaggacacactgactcagctgccagtggcttctcctttgcctatgaaacactggctccttctgcaattggcagcctgggcccagcactaaccccagcagggttagagtgttctagaatgccccccttctctgttattaagtgaaaggaagggagcgggctgtctcctgcaggggctgctctgagaatcccaggccccaggccccacctgcctggctctcctcaccagcagtgaaattatcctcccaggaaatgcaccagaccccttgattctgcccccaaggccttgacctcggcctggcttccccgagacgttgtgtctgtgccccttctcccctgagctgagcagcagtgtgttccctagtccattcccagcccagagcatgcaccccccgccccgcccccacctccttcctcatcctggagcccagggagccctgagtcatggctcacccggctgaggccctcttgcccagctgagaccctctagggacccccacagtaacagtgcccagaacaaagctggcatcacaaagcatcggggactctgcctcagccctttgccagtcttgtttccgtcccgtcctgctggccctgtccctgccatctgccctctgctgtgccaggcagtcatttgtttcccagggcttgttgggggcctccgggcctccagcctgccatctcctcactcccaattgctgtgccaaaagccactcttccccactagagcgtccccatggcccttctcccaacacccacccatccaccaagcccaccccaccccaggagggcaagaccccatttgggtccctctcatctgccttccagggcaaaggcggcaccaagaccctgatgaacaccatcatgcagctgcggaagatctgcaaccacccctacatgttccagcacatcgaggtgagcccgccgcggctgggacggctcaggccctgctgtctgctgagctcctaggcagagctggcttctcctcgacagctctttaaaaacagactcgaatattttcattaggtaatgcctgtacatctgtctctcatttggtcttcgcttcaccagtgcttacgggaagaatcccagcagttagggcgcaacgtgcgataggaatatagggccctgaaagcttgccctcagagagcaggagcgtttggagacttctctggggatgtgtccccccacagtggggtcctgctgcgtctctttggctcactggcttttctcacgttgcggggcgtcaagagtcaccaccgtcttcagtgaagtgtgggggagtcagaaccctttttggtcatggtggctttgagaatctgggttcttagaagcatgcatatgttcgtgtttcttggtgtaaagtgtcagggtcgttggagaccgcctgctgccccgagagcccctggggctgtctcagcaccctgagcgtggctgtggccccatgacgtcctcgtgcattcagggtgtgaagagtgctgtatgggatgtcctttccttcgttggaggagtgtgagggaaaggatgtcagtggactaagaaagatggttttggcatctgtgtctggtctcagagccgccgtgggcccgtgccgagcacacagtgtgggggctttgtcctctgagcacgagcggtgtgtgcggaccgcagcggggcccggtggcctgctcctgcctgtcactgacccctctctccttgccttgcaggagtccttttccgagcacttggggttcactggcggcattgtccaagggtgagaagcttcccaactggatggggtgggcaggtggtccacccagaggttttctgtcgttttgttggctttattgctgctgttatgttgtccaatttcaaaggcagaaaattagaaaatacagaagaatccaaagcaaataatacaaatctttttttttttttttttttgaggtggagttttgctcttgttgcccaggctggagtgcagtgacacaatctcggctcactgcaacctctgcctcctgggttcaaatgattctcctgcctcagcctcccgagtagctgggattaccggcacctgccaccacccagctaattttttgtatttttagtagagatggggtttcaccatgttgaccaggctgatcttgaactcctgacctcaagtgatccacccgccttggcctcccaaagtgctggaattacaggtgtgagccaccgcgcccggccccattatacaaatctttagtgcttggagagctgaccactattaaccccaagagacaggattcctgaggcagacctggcttacagatcccactctgccgcctccaagctctgtgactctagacagctttcttaacctctctgagcctaaactctgctcactagtacagaggcactctttacatcatgtgggtgttttctatagcaccctttgtaaggggcagcccagactcctttaagcccctaatggatgtggatgctgtgtctagattttcaccattgcaaagaaccttgctaaaagcattcttccagctaaagcctccattcaattcccctggggtagtaagccatttgcaagaagagaggcgcctaatgaaaacatcacaaattctttttgatgtgtttttttatactgagttgtggaacagggtcctgtacacctggcttcaaggctgggaggcctggcttggacatgtggtcagccatatcacgtcgtccccctgccagcctcagtgtccacatctacaacacttggggtttggctggagagaacatgagaagccgaggtggcccttccttctgggtctagcagagcatgggtgtctccagtgtggcatttgctcctggggcttctttatcgggcaaggggacaaggtctggcttcccggagcatccctgttccagccccgtgttgtgccggccatgtgactcacagctcctctcattttcatgagtgtctgggtttgacgagaaatacatgtgccaccctggtgatacgcctccccagcgagggtggccgggcttatttcagttgggggaaatggctttgctgaagctttgggtgggtgacgtctgcttaggatgcatgtctgtgcccttgaacccggcgcctggcctggaggcgggcgatgcacctcctgccttacctgcctgcagggttccaggtttaacatcctgcgccttctctcctgcctcctccacactccaggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggtgagtatgagccagtgaggcgtttcttacagggttttgttgttgtggctgccacagaagctcctcactggcattccctcctgtgaggcagggtgaggcccaggcgctctgggtccagtggccagagtgggcctagccacaggctgagcatcttgggcactcggcactgggacaggccgtggattggacgccgggtgtcctgactcctaggctgacagtctttccacgacaatgctgggcgcactggggaaggggtgccctgtgcacttttagctggaagtgacagaattccataccatgtggacacaggaaagaaagcaccaataggcttacatagctctaaccccaggaggttaaacatccttcaggcacagctggatccaggcatgcaggtgatattggagagacttttctccagctctttgctctgccttcttccatcttggcttcctttccacctgctcagtgtccccaacaaaggcaggtcccaggctggctctcatttagctgctgtgagccgcatgcccatccctgggccattcgtagcagcccagtgactgccaccttgccacaggtcaggcctggacctggaatcagactctgtggtgagcacggagggagggaagcaagcactgccaggcaggagcagcagctgccgtagagaggctctcagcccaaccccctgccctgcggtccctgatgggaaaggtcaccgcctgtgtttctgcgcctgcctgccccagcacacgggagctcagggaggagaggctgtgagatgccgacagggcacgtgagacatgtctgtcagtcccagtgggtcagggagccctggagtgagttcttcgtgggagttactagaactgggcttacgagaaacacgagcatgagctgctgagacagacacggctcagccagtttgttgttccctacacgacctcccagagcctttgttgaagctcctgtgcaaggtctgtctcacagcaggacaccccagacctccataccccttgtcccgttgatcacttggacctgtgtttgctgggccaacctgcccaggtgccacccggagtgtgccctgtgtgtccctccaaactgcaggtcctccccggggttctgtccaggaccactctacagacacgagtctgttgcaggggtctccccggcttgccttcttccttgggggcttcccactttcagctttgaggctgaaaaccaaaatccttcagggtcctcatggccgggccaccccccaccctttcctctcctacggtctctccagcggcttctcccgtcctcgagagggccaaggcttcctgagggccatcccgtctgtgtcgtgtccctgactcccccaggagagagcctggttcccacccatcccagtgcccttctgcctactccataaggacaaggactttggtcagttgaactacagatgtgtcctctgcatgtgatgtggtcatggccacagggccagagaatccattgcgagtagaggaagggtaggagctcagtgaagtctcctgagactgcatctcccatgggtgggctggcatctgggagccgggtggcccctcacctcagcccctcctccgagctggagtagcaggggcacatctggtgcctgagagagggtgggacggcaggtggatggccaggctactgtgggcttctgcaccgtgcctgggcatgtgtaggctggtggcaggaaatggccagtttttatttcttcttttttttgagacggagtttcactcttgttgcccaggctggagtgcagtggcatgatctcagctcactgcaacctccgccgcctggattcaagcgattctcctgcctcatcctccctggtatctgggattacaggcgcccgccactacgcccagctaattttcttgtatttttagtagagacggggtttcaccatgttggccaggctggtctcgaactcctgtcctcaggcgatccacccacctcagcctcccaaagtgttgggattacaggcatgagtcaccgcgcccggcctgccagtttttatttcatcaccaaaatgacttcagtgttcaggggcacctctgtccgaactcccagcagcgcagggagtgttgacattgccttaatgcccacaacgctgagggcatcgtgggttgtcacccaggagacctgctctggctccttgacttgggttttctggggcatggggacactgatcctgccagaaaggacacgagccccctttataaggtctccatgcttttaccgtagaagattctctttgtgaaccacaaaactttttgagacagggctgaaggcaggtgcacccacagtcactgtccacccacccccaggtcccttgtgttgcgagcggcggtgttgccggcattggccgctgtgtcttccgctccccatggaatggcacagggtagagtagaggagagaatccagggctgtggtggtggtggctgtgctgacgctggacgctgtggcctagctgtgggctgggtgctggactctgtgctccaggcccacctcctctagttctcccagcggggcctgttttcatttctgggatgtgtggagagacgttttgtggtgaaacactggaaatccagttattcgccagtggcccacaggcccgtgtggagagtgcggagccagggatctggggatgctggcaggtgctgatcctgctcctgctctcagaagcaggtgttccttggtgtccccactctacccctgaggtcaccccgctgaccctgttctcctctgtgcccgtcaggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggtaaaagcgggccgggccccaggtcgaggagaaggaagggggtgcctgcaaaacctcgaggagacggccctggcttgagggtcctccagcctcctccacattgtcttggaccccaggagccgggaggagctgcacccatatctccataggtcatcagggagaaaagaggcggggtcctcctgtttcccaaaatacaaacagcctttccctctgattgggaaagcagtgtataagccatccgtcggtttggtttttcttaaatcttggaatggcacccatgaggaggtggaaagtatcctgatcaatctgcgccgtcactgtggggcggcccctgcagtgtgccctgtgagcacacacactggcgcttgttcagacacaattgggggtaaactccatgccacttcgtttacttcctcctcttgttccataaccatgtacccctcatgggcctcggcatcggtggataccaggtcatgctgttacatagctacaagaatttgaaaatgagttaaacttttctctgtgtttcattataagactgataagttcttattgtttttaacatgtaaacaccagtgacagtcaggagtcccttttcccttcctctccaaccgtgctctcttctgagcctctgccagcccatctgccttcgcacatgtatgtactgagattaacacagatgcggcgtggcctagcatgtgcctcttccaccaagcagtgggtgtcaaccgccgagtgcacatcggaagctacccagccatctaatcggccaccaggcgtcccggcagatggccacccctggacgtctgctctcaaactctggttggcaggcatccgtcttttctgttgatcagcctggtcaccaacccagcagggtccctctttctctcagagtgcttgtgcaaacaccctaggtctgcgcagccctcagacatggggtcgctccaccccagacattgtcctcttcgtgttctggttgctactgccaaagtggtttcactcctacgctggggtgtgaatgtaccctgcccttccctgcagcgtgagggcagcagcgttctcagtgtgtaaattgtcgcttgtctgatgggtgaatgccgtggtggtcactggtggccccttttacgatcaggctggggtgtagcttctgcccagaccctggtgaccagccagtttcttaggaggtggttgagttgtgtgtccccgttggcaggccggcagcaggcggaagctgcacctcagggctgggggcgcgttggggagggctggccctgccaggaagtgtgctgacagggcaggagggctgagcggcagacacaaggcactcctggtccccaccagctgtggcctctgccaccccatgggtgccagtcttaagtttcagagcatcactggtactcaccctggtcctgcagctcctgggcccagagacaggatttcgtgttagcctcctcgtactgtgctggggtgatgataaaactaacaacccaggctggacgcagtggctcacacccgaaatcccaacattttgggaggccgaggtgggtggatcaactgaggtcaggagttcgagaccagcctggccaacatggcgaaaccctgtctctactaaaaatacaaaaattagccaggcatggtggtgcatgcctgtagccccagctactcaggaagctgaggcagaaaaatcgcttgaacttcgggaggcagaggttgcagtgagctgagatcgcaccactgcactccagcctgggcgacagagcgagactttgtctcaaaaaaaaaaaaaaagaaaaaaagcccatccacggcacctgcattgttgggagctaactgcaccagtcactgggccacactcctggtgcttattcactcattcgaggtatgcagtagccacgggttgggccccatgtaggctgagggagttttgaggctcacagaggtgagacctggttccggttctgtgtgcactgtgagagtggcagggcccacagccaaaccaagcactgccacaacacggccgagcttcggccccctgttgtaaatggtgctcgactgtgtaggtccacgctgtggggagctgtgccgctgccacgggagctgcttgagaatataatcccctggggggttggtgctttcttcccgaatatctgtggggtcccaataaggtagaaggtggcacttctggaggaacgtgatgagagtccccttcccccgagggacacatggcggcccaggctccaccagctctgttttcatgcggcggcaggtcaggctgggcagaattgtcaggccgagggtggcacgcacagcacacctctccagctagtgtcagaggccaccttcccttttatgacctcctgggctcctttgggactgactggcacctcttcccccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggtgagcccagcaccggccccgacccctccccagcgtgaatggtggacgcgtgagcggctttcatttttgtttttttaccttttttgcactcttattttttttgcatccctttggagtaaagggagtgtgggctgaacggaaagaggatgagtacttgctttttctttgaagtggtttttttttctaaactgctggtgaaagacgccggattgacagccctggagactgaagtcctctatttatccacagagcagacactgcagcacgggcagcggcagtgccagcttcgcccacactgcccctccgccagcgggcgtcaaccccgacttggaggagccacctctaaaggtgagaggggtagttcagtctccatgcccattcaatcctcggcttctcggctgagacggccagcaagggccctggtcccacggagcgtgcgtgtgcgtgtgcgtgtgtgtgcctttcgctgccgtgtgggtccccatccaccgcagccgtgccgggaccaccagctcattcccacggacgccgccgctcgcctctgagctcggccgccgcccaccccggcccctcctcagcggcactgacagtttgcaatcttataggaggaagacgaggtgcccgacgacgagaccgtcaaccagatgatcgcccggcacgaggaggagtttgatctgttcatggtaagcgctgcaggctggatggggcagttcaggcatcccactctgctgccaccaggagcaaagcagacgtcctagtgcccatggtggtatccctagcaggtcagggagccagggacagctcacagtgcagcccactcccacctccagactgacccgtcttccacccccagtctcctgaggatggcatcggagggcgagatgcacacccagccttctgcatgtgacccgagacctgccccaccagctctgttttctaacgggctctccagggcttcatgcactccctttcagagggagttcgccctatccaaggccaagggactgaccaggccttcagtcgcagagcccccttgcccctgggtgggaaacaggaaataagccacccaagcaggggccccttggcccgcaggcctcatgcctccaccaacgctgggccacgcagctgctgcccccctgctggggtctgcagccctcttgtgcaaccttccatcttttcgagtttcctctgcctcctgaggcagagcctctagtcagggtctgacggagccaggccaggtcagccactgaaaaatcgagagctactgtttaactctcgcagcagcgtggagccccacgggcagagaaaggcccttctgaactctcggtgttctggctctagcgtgcccctggtgcctgcatgctgatgcctctcccgttgcctccctgcccaccagcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggtacatgctggagaggcccagcagctgccgcaggccagcgccaggcagggctggggagacaaagggcccaccgccaggactcaggcctgggtccaaaatgctttccttgggccactcctggccaggctccgcaggcagccgagagccttccgatgtgggccagggatggtcaggtccttttggctctgccttggaatgcaagaaggacccacggttcctgagcagctcaaaacctgctgctggttatggttggtctttcaagtaaaagggtttacctcttcccgaggttaaaaatcatgttgctgatctcagtggactgctggctttcccagtacctgccaggagggaggcacaagggtgaatcatggactattgaggcgccctgcaaagcgttgcactgctggctgcaggcagcctcactttgggcaagtccccccccatgagctggggagactcagtcatggggagggaggagagggcaagcccccaagggcctctgaacctggcaggtgctgcacggggctggcagttgcttgtggagctgacgtgagggcccgttctcagcagatggcagctggccctgcaacagcagctgcagatgtctttgagtcagtcgtgcggtgctcctggggcttcacccgacccaactttcccagcccaaggcacactgtgacagatgcctggcactgatgtcctcactggggttacggtgacagatcagaccccttcccagctcaggggctctgagttatagagacgatgattcagaatccatccctgaagttgtgtcataaaaatgtcctgaagcaataattccgagaaggcaggtggcagcttttggctatgccatgcaaagtgccacacccaggaaagagccatgtggcctagcccatgtggccaaacagccccggttccctcctgggacctcagcagcccagactcatgagcttgcctgccaagctgtgcaccagagggcgctgttgaaacacaccaggagcccaggtgacagacaggccatcctgttccccagccagcctcccaagcacagcgctccaggacccagaagagaaaccctgaaaagacagtgtgagccctgccacagacctgtgtgacagcagagctgtttggctgctgtatgagtgtcaccggccctgcatttttttcttttttaataaagacaaagtcttgctgtgttacccaggctggcctccagttcctgggggctcaagtgatcctcacacctcagcctcctgagtagttcagactacaggtacacaccaacacgcctggctaattttaaattttttgtaaagtgggggtctcactgtgtcactcaggctggtctcaaactcctgggctcaaacaatccacccgcctcggcctgcagagtagctgggattacgagcatgagccacggtgcccagctcagccctgcatatttgaggcagtgagtaccttttaaatttaagatcagttcatacgtggctgctctatgtacatttttttctaggtgtaatttacataccatacagttcacccttttggggtatatgatacaatcatcttcagtgtatccaagagttgtgcatctctcaccacagtccattttagaacattctcatcgcccccaaaagaagccctgccccgatttgccattcctggtaattcatggattctccccagccccaggcaaccactgatgtactttctgtccatatagttttacctgttctgggcgtttcctgtcagtggagtcctacagcgtgggatgctttggtgtcaggcttttttcacgcaatgtaacatgctgacccatgatgcagcaggtgtgttgcattctttgatggtgaaataatcctgcctcgtacagatttgtcacattcggtttttctgtccattcttgatggacacttgggttgtatccactttcgggctattacaaacaatactaccgtgaacattcacgtacacgtttttgcgtgcacgcgtttctctttaatatgtgatttctctttaatatctgatttctctttaatatgtgcctaggcgtagagttgccggaacaatgttagttctctatttaaccttttgagggaccccagcctggtttccttggtggctacgccagttcacagttccaccagctgtgtatgagaattcctctttctctacatcctcagcaacccttgctgttccctcgcccgctgattctagccatcccagcacgtatgaagtgccatctgagtgtggttggatttgcatttccctgatggctaatggtgtggagtatctgttcatatgcttcttggccctttgtgtatcctctagaaagagatgtctagtcacatcatcctttacccaaatttaaaatatatttatcttaatattgaattgtaagttatttacaagtgccttatcagatatcatttgtaaatattttgttccattctgcacattctcttttcgcttccgtgatatccgttgaagcacagaagtgtttcattgtacttacagtcgatttttctttttcacctgtgccttggtgttgtatctgagaaaccatcgcctatccaaggtcacgaagacttgcccctgtcttttctcctaggagggttataatttgatctcttccatgtagatccatgtaagatccattttgagttaaattttatacatgatgtgaggtaggggtccatcttcatccatccaactggaaatccagttgtcccagcagcatttgttgaagagactattttttcccattgagcccatcttattacacagtatattcaaattcacagttgtgaaaaatattatacaaaacactgtctccccactactgttggctgtggaattggcaccacttttctggcagccatctgttgccaagtgaactcaaagccttcaaaatgctcctatggccgccatcggacatggccatgactgtggcagcctaaagcaacagaactattttctctgcattctgggccagaagtctgaacccacggtgtgggcagggctgtgttcctttcgaggccctaggagaggacccttccttggcttttccagcttctgatggttccagaagcctcctggcttggggcagcgtcaccccatctctgcctctgtcttcatggggacttctcctctgtgtccccttctgtgtcttttaagaacaatttttaaaacttaatcccaaaagtaaagacctcatttgcaaagaaggtcccattccgaggttccaggtagacatgagtctggggggcacccgccgctccgccctgggtctgcagggggccttctcctggtgcctcctgcctgctgtgccctccatgctgcttctttgacccggttgccttccatcctcctgggcccctcaggctctcagcttcccatcttctctaagacatgtctgctccatcattctggtgtctctctcttccctccttcctggcacctgacacgtttgttaccccacttgtggggtgttgctgtctgatcaccatcttccttccaagggtaggggaaagggccctggctggttcaagtcacagctctgtcctcagcgccaggcacagtgcccagctcactggcacagcctcagattccctggacacctggctccccggctgcattttttaccattgggataagttattagtaccattgaaaattaatacctggggattctcttaatattgttcatattcatgttcttctcagcagttttaccatgaggaatctgtcttaaacaatgtcagttgtcaatagcgttatttaaaatagcaacaacaataaaaaaaggtggtcagacctggcagcttgtgcctgtaatcccagcacttggagaagccaaagcggggggatcatttcagctcaggagtttgagaccagtctggccaaaatagcaagacctttgtctctattaaaaaaaaaaatgccaggcacagtgacacatgcctgtaatcccaagcactttgggaggccgaggtgggcagatcacctgaggtcaggagctcaagaccagcctggccaacatggcaaaaacccgtttctactaaaaatacaaaaattagccaggcatggtggtgggcacctgtcatcccagctacttgggaggctgagtcaggagaatcactggaacctaggagttggagtttgtagtgagccaagatcgcaccactgcactccagcctgggcgacagaatgagaccctgtctctgaaaaaaagggaaatgacctaaatgcccaagaacaaggggaggctaaattagggcacgttgtgcactgaaacactaaacagacattaaaaaattttgttgtagaaaattacaggaaaagatatccatgacacagccagcagtgtggcacgtgggctacaattccagcgtggccttcagttctgcacacgtgcgtcaaaggtggggagagttctggtggtgggtggcgctgagggctgcacaacactggggacgtgcctaatgcccctgaactgtgtactaaaacatggctgctttggtaaattttatgttatatatgatttataatatatttttttaaatgcccagctactcaggaggctaagatgggaagatcacttgagcccaggagttaaagtccaaccagggcaatgtagcaagaccacatgtctaagaaaatttaaaaatcggctgggcgcggtggctcacgcctgtaatcccagcactttgagaggccgacatgggtggatcacgaggttaagagattaagaccatcctggccaacatggtaaaaccctgtctctactaaaaataccaaaattagctggacgtggtggtgggcgcctgtagtcccagctactcaggagggtgagggaggagaatcgcttgaaccaggaaggtggaggttgcagtgagctgagattgcaccactgcactccagcctggtgacagagcgagactgcgtctcaacaacaacaaaaaagaaaatttaaaaataatttttcatacaaaaattagccaggtgtggtggcacgtacctgtaatcccaggtacttgggaggctgaagcaggagaattgcttgaacccaggaggcggaggttgcagtgagccgagattgcaccactgcactccaacctcggtgacaagagcgaaactccgtctcaaaaatataaaaataatttttaaaatgtcttaaaaaggccgggtgtggtggctcacacctgtaatcccagcactttgggaggccgaggcgggcagatcacaaggtcaagagtttgagaccatcctgaccaacatggtgaaaccctgtctctactaaaaatacaaaaattagctaggcgtggtggtttgcgcctgtaatcccagctactcaggaggctgaggcaggagagttgcttgaacccaggaggcggaggttgcagtgagccaagatcatgccactgcactccagcctggtgacagagtgagactccgtctccaaaaaaaaaaaaaaaaaaatcttaaaaagaagaaatagatggaggccaggcccagtggcttatatctgtaatcctagcactttgggaggctaagatgggagcactgcttgagaccaggagttcaagaccagcctgggcaatattatgagaccccgtatctacaaaaaatttttttaattagctgagtgtggtgacacgtgcctgtagtcccagctacttaggaggctgaggtgggaggatctcttgagccctgggagttcaagactgcagtgagctatgatggtgccactgcactccagcctgggcaacaggtcgagaccctgtctctaaaaataaataagtaaataaaagaaatagatggggagagtgtggaacagaggtgtcaacatcacctccgggtgaagggatttcaggagcacgttcttttctgtacagagaagatagttctttttttttggtcaagaaattcaaccattagttttttaaagacaagcttgggtggggtgcctgctgggggcagtgctggtctttcactgcagcccaggcaccccttgagagtcccagtgtgtgttatgccccgagccagtcaagctgaagggagagcgggtgcgggggccctcctccgtgtcccagcccggcccctgggattgcgtcgcggcctctgcttgtcgacctgggtgctggctgtcctattttactactattgaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacaggtaagcgaggaggcggggagggcgggggctgtaggggtccccgtgggagcaggcctggcatctgcactctgactctgcacactcaggcttgggccgctcactctttcactcatccacaaacactgactgaatctctgtgtctttgagcctggccctgaggaacatgctttctggaacagggaagcacacatgtatctgcggtgatgagagggaatgtcacatgtggtcgagaggagaggcaggggtgcgggtctcggagaaggggacattgcagcagagccttgagagaggggaggttggggagagtgcaccagcagaggccacagcaggcggagaggctctgccaaagttgtggcctggtggcctcaagggatgaggtgggatgaggggttatatggcagtaatgggtgctgcccgtgtggccaggaggttggggacaagaggctggcatgtctggagcagagaaagtggcagccctctcctgtccttgcaccctcccaggctacctgtgccatctctgtgttggtgagatggtggccacactcctgctctctgccaggccctgctccaagcctggagatcgctgtcctcacagacatgtcctatatacgaggcagcatgcggttccagctgtggccacggcccagcggcggatcataacgtgttggtggatcatgagtgccatttatatgtttttcatttactaatatccttttccgtgagcgactctatatgggtaccatttaaataagaagaaaggaatgttctcagcaactccccagggaggcatgtgcaccttctgccagcccagggcaggtcacagagctgggcaggagccagcaaaggtgtaaggcccatgcctggcccaggactcacccagtcttccactctccaaggtcttatttcacttcctggtacacactggccagtacggctgtccccgtaatgggagggttgtactgtttgattttaaataacagtttgctgttagtcatgaagcagagcgtgggggaattgtatctgttggaggggaaagtgaagggagcccacatgcatggtttggagagaatcttaccaagtgtgaagttttagaggatggtaacaattggagtgcctaaattaatgagtcaaaattaccgcgcaaggccagctgtggtggtccacacctgtcagcccagcactttgagaggctgaggtgggaggatcacttgaggtcaggagtttgagaccagcatggacaacatggtgaaaacccatctttactgaaaataggaaaacaattacctgggcgtggtggcacgctttttgggaggctgagacaggagaatcacttgaacccaggaagtggaggttgctgtggaccaagattgcaccactgcactccagccttgggtgacagagcaagacgcccactccaaaaacaaaatactgcttaaaaaggttcttttagccagatgcggtggctcatgcctgtaatcccagcactttaggaggccaaggcgggcggatcacttgaggtcaggagtttgaaaccagcatggccaatatggcgaaaccccctctctactaaaactacaaaaattcgccgagcgtagtggtgcatgcctgtaatcccagctactcgggaggctgaggtaggagaatcttgaagctgggaggcggaggttgcagtgacccaagatcacatcagtgcactccagcctgggggacagagtgagactccgtctcaaaaagagaaaaaaagaaaggttcttttattattggaagagaaacagatgatgaaggaaaggagacatattcaagttcaatgccagatctgaaaatgtcatgtgttgtcagtattgagaaaaaaatatatagactctaattcacaaacctaactccaaggctaagtcctcaaagaggaaagcaagtggaggacttaagttacttaaagtgcgggatacagctgcgggcagtagcacatgcctggggtccccactacttgggaggctgaggtgggaggatcacttgagcacagcaggtccaggctacagtgagccatgatcacacagctgcactccatcctgggtgatggaatgagaccctgtatcttaaaaaaatgaaataaatacagaatacttatttaaaacatgggccaggtatagtggctcgtgtaatcccagcactttgggaggctgaggtgggcggatcacttgaagttaggagtttgagaccagtctggccaacatggcaaaaccccatctctacaaaaaatacaaaaatagaaattaaactggcatggtgatgcgtgcttgagctcccagctcgggaggctgggcacgagaatcgcttgaacccagaaggcagagggtgcagtgagccaagattgcaccactgcactccagcctgggtgacagagtgagacaatacctgaaaaacaaaaaacaaaaacaaaaaaagggaattcgcagaaatctaatgacaatgacagaccctccccatgttttatttctaatgataatcttgtgagggaaacttaacattaccaacctaaagaagacccttgaagcgcagtggggaaagcacgggtgtctccatcacactggtctcctgggtatccacgtagagaggatgagcctcgaccacccccacacacgcacacaccatgcacttggatccacgtgacatggactgtggatgtaagaacgtgaaaggtaaaacaaaattctagaagaaagcacgggagaaaatcttcatgagtaggcatcgatttcttccacgggagccaaaagccactaatcacaaacaattgagaaattagacctcactgaaattaataacatctgtttattaatggacacgctgatggagacagtgaaaactcctcatagatgaggaaaagacaacacaatttaaagctggacaagagccgggaacagacgcctccttacacaggacatcccaggactaatcaatgtggggaaaggtgctcacgtcattgcattagcatcacaacttcaagaaaatgctcgttaaaaccagagtgacttgcaccagcacccgccccagaacggccgaatgcccatcagtgctggcaagtctgaagcagtctggcctcacaccctgcgtgtaggagtatgcagctctttggcaatctcttctgttttgctttgtttgtttttaaccatcgaactgcagaagataatattttctgaggctcagcctgtacataccctctgacccagcagcctgcagccctcgttctacccaggagagctgagtgcatctgtccacaccgacagacgtgtccatagccactttggtcataatctcccaaaacaagaatcagcccagtgtccatctacaggggcatggatcagtggaggcctaatcgtacagggccccaaacagctgtgaaaacagacatagtactgctacctggaagaagcttacattttgttgagtgaaagaagccagacactaaaaagggcatactggccgggcacggtggctcacgcctgtaatcccagcactttgggaggccgaggcgggcggatcacgaggtcaggagattgagaccatcctggctaacatggtgaaacaccgtctctactaaaaatacaaaaaattagccgggtgtggtggtgggcgcctgtagtcccagctactcgggaggctgaggcgggagaatggcatgaacccaggaggcggagcttgcagtgagccgagaccgcgccacggcactccagcctgggcgacagagcgggactccgtctaaaaaaaaaaagagggcctactgtgtgcctccagttctgtgagggtcagaagctgatccacagtaatggctgccaagcagtgcttaccttgagagagggaatagcaggaaagccacacgacgagccttctaggatactggggatattctctctatagatctggatgtgtatatgatgtgtacattcaccaaggtgtacacatgagatatgtacacttctctgtattccattacaccttggtttttgaaaagacagaaacagcatgctcagcttattaagaacctgaatattttcagacaaaaagtatgtctagtgttagtccacttttttttttttttagttttagactcacagagccctcttagggtcatatttagttgtatatcatctgacaaaagagggaatggctcacccagctgctacagtcagtcttgtagcctttgtaagatttgatgataaatcatacaataaattaaaactttcggctgggcacagtggctcacgcccataatcccagcactttgggaggccgaggcggaggatcacttgagcccaggagttcagatgagcctggccaacatagtgagactctgtctctatttaaaaaaaagaagaaaaaaaaagtctgggtgtggtggctcacgcctgtaatcccagcactttgggaggctgaggcgagcggatcacaaggccaggagatcaagaccatgctggctaacacagtgaaaccccgtctctactaaaaatacaaaaaattagccaggcgtggtggcgggcgcctgtagtcccagatactcgagaggctgaggcaggagaatggcgtgaacccgggaggcagagcttgcagtgagccgagattgtgccactgcactccagcctgggcgacagagcgagactccgtctcaaaaaaaaaaaaaaaaccccaaa

SEQ ID NO: 14947 - DNA, 5088 bp, Homo sapiens; identical to SEQ ID NO: 7228
  misc_feature (5)..(304): n equals a,t,g, or c
  misc_feature (3943)..(4892): n equals a,t,g, or c

SEQ ID NO: 14948 - DNA, 465 bp, Homo sapiens
ctacgttggaattacaagtaggacaacaaagatgactattaaagaaagcctcctgagtgctggaagcacagcaggcgtgggtctgtccactcactgtaatgtgatttgcacaggaaaacatcacatagggcacatcaactcaggaaagatagtcgttgaaaagctacctcagctgggcgtagtggtcacgcctgtaatcccagaactttgtaaggctgtgaggcttgtggatcccttgagaccaagagtacgagaccaacctgagcaaaacagggagaccccgcctatgcaaaaaatacaaaaattagccaggcgtggtggtgcactcctgttgactcagctattcaggaagctgaggcagaaggaccacaagaagtcaaggccgcagtggggtataatcacatcactgcactccaccatgggtgacagaggtgagaccctgttgcaaaaaaaaaaaaaaaaaaa

SEQ ID NO: 14949 - DNA, 228 bp, Homo sapiens; identical to SEQ ID NO: 7231

SEQ ID NO: 14950 - DNA, 5012 bp, Homo sapiens
tgtaatcccagctgctcaggaggctgaggcgggagaatcacttgaacctgggaggcggaggttgcagcgagccgagatcatgccactgcactccagcctgggtgacagagcgagagaccctgtatcaaaacaaacaaagaaacagcaacaacaacaaaaattagcctcgggtggtagcatgcatctgtgattctcagctacttgggaggctgaggttgaaggattgcttgagcccaggagatcagggctgcagtgagctatgattataccactgcactccagcctgcatgacagaccaagaccttgtctcaaaaataagataaaaataagaatattttcaaatgtttgccaatctgatgggtgaaaaaatgcaaattcattgttttcactagagtttccctgaatagtggtgaggctgcgtatctttggtatttggaaatgtctacgatatttgtccacttttcaaaaggctcatttgttttgtttgtttgtaagttagattttttcctaattgtatgcatattctttttttgttatatttattgcaaatattttctcctactccattggtctttttgctttatgtaggtacatctggaagttgttttcttcatagctcccaaggtatgaaaatattctcctacagttttgctgttgttttttttttcctttggagaaaaccatttttattatcatcaccacccagcttatttgtgctggattatgtaccagtggcaagatcttctaacgaacatctgcataacatttattttatgttttaaaagatgaaaataactgtacaaggttaagtacaaaagtacacaagataacagacacaaaaaaatgcatgtatgagatttcattctacctacagcactttatgttcaaaaagtagaattcacgaaccaaaaaatattgtccttctatagtcctgtcaggtttagtgaaagcgagtctaacatgattacaacacctatatcactgatctgatatttatgaaaaaaatcttatttttcaataaattaaagccaatgcaaatgggaatagcatttcagttttttggtgtttttcttttttttaattttttttattttgagacagagtctcactctgttgcccagactggagtacagtggcatgatcttggttcaccgtgacctccacctctcaggttcaagcaattcttgtgcctcagccacctgagtagctgggggttttcaccatgttgctcaggctggtcttaaactcctggcctcaagtgatccacctgcctcgccctcccaaagtgctgggattacaggcatgagccaccgcgcccggccatgtttcaggtttataaaatagagatatgaacatggatggtggtgatggttgcacattatgaacgttatcgaatgctactgaattgtacacttaaaaaatggctatgatggtaaattttatgttacgtgtattttaccacagcttaaaaaaagagagaggaagaaaagccagtgcaacaccctacaaactggaacactagctctttgggaacaaggacctgacatcagaacaagaaggctataagttcccaaaccttaaaagtatgatctttttcaaactgcatccatttctcacgttgaagatgtgaaacccaatcccgttcctctttatgtgtgggtctgtgatcttgccttttcatactgagcatctaaatttctaaatacagtacttcctattgcttcaaagtcttctaactttcttcatcaagtgagctacatctagcttcatcttcactcttaatacccactaatttccatatatatgacattttggtccttgtttcccaaagtcatagttcagcagacggggagtttgcccagtttttcttgccttgacttttttcctcttgttcagcaaatttcactggatttccagctgctgtgtcataatccctaggtacagctgttctgtctctgccaaagctgttgcttgcagggctcccatttgagctgccatagctatctgagttactggcattcctgatgccaacagggcagcaacattgagaacaaaatctctagtaactggagctatttcttgtttttgtttttcaatgatttctttttcttttaaaaaattttttcccaacacccatcccaactatttctttttcttgctgttcttgtaatttctttgcctagtccatcctcccagctaaagcttcttatgcatcctttgctgtgcctctgcctctgaagagagatgaactggaaatctggcttaaacttctgctaaatcttagtttctcaatgctcttctttctctcttgtcttctgcttcctgtactacttctgcttctttcctatgcatgtcatatttatttatttacttatttttcacacgcaacacagatgtagtttttatcttgaacaggagcaagatctgatccatggttttctttctttcttttttttttctttcctttttggagacggcgtctcactctgttggccaggctggagtgcagtggtgtgacctcagctcactgaaacctccacctcctgggttcaagtgattctcctgcctcagcctcccaagtagctgggacctcagacatgcatcaccacgcctggctaatttttgcatttttagtagagacagggttttgccatgttggccaggttggtctcaaactcctgaatctcaggtgatctgcctgacttggcctcccaaagtgctgggattacaggtgtgaagcaccatgtccagcccatggttttcttttcctgcttctagatcatgatcgttcttctctctgcttctggattgagactacttcttttccctctactacgatgatgcctttcacgagacctgtatcttgagtgacttctgcttcttgatggctttctttgtgtttgtgtctgtcctcatcattttcagatgaatgtatttatttattgagacagcatgtcactctgttgcccaggctggagtgcagtggcacaatcacagctcactgtaacctctgtctccccggctcaagcttctcaccacagcctcccgagtagctggaatcacaggcacacaccaccacgcctggctaacttttgtgttttttatagagacagggctttgccatgttgctcaagctggtctcaaacttgtgagcccaagcaatttgcccaccttggccttccgaagtactgagactacagacgtgagtcactgcgcccagcccattttcagatgaatttagtccctctcttcctttatcagaataatgttctttgtcattatgctcctcagaagtgtatttcttagaggatttgttgtaggattcctgtcttcttgcctcatcatgaaataggcttattattttcctacctgagtctgcaatgtcttcagttcagcctctttgcccatcagcatgcgctttgtgttttcgtccttcgttttctttcttgttttctttctcttgaccttgattgtgatcttgaataatattttgagtaagaaaaacagatgcatctgacagttctttttccacccactatctggggatgtctttttctggggctagtccatcttgtcctggataactaccctatcttgagaacccagtcttagtttcatgaaacatctttaatgaaaacagccttttgggatggtgctgctgcaaactgtggtctggctctcctcgcatgtgctctggctgccgcagaacagagctcaggccgctagggggcacctccacgtgccgcttttagcagtaccagccacctcaaagctttgccacagactgaatagctccttccgggggcctggatggcacccaggggatctgccgttgcttttttaatttatttttttacatttagctcattaatatctgttagatatttttatgtctgcattgaaatatgtaactttatttttcccccaaaggataactgttccaacattatcagttagcttgtcttttccccaccaacttaaaatacgactcttatttttaaaattgcattttataaacatgtatgtttcagtaatttatattctgccccactgatctatattcccatcttagaattatacttttattttatttttaaaatttatttagagacaaggtcttggtatgtcactcaggctggaatgcagtggtgcaatgataattcactgcaaccttgaattcctgggctcaagcaatcctcccacctcagccttccaagtagctgggactacaggtgtgtgccactatgcctggctaatttttttatttttatttttttgtggagacgatgttttgctatgttgcccaggctggtctcaaactcctgggctcgagggatcttcctgtcttggctgcccaaagtgttgggattataggcatgagccacctcacccagccttagtattatactattttagttaacaaagctttacaatgaattttgatacctagaaagactgcacccaggtgaaataaacagccttgtttctcacacaaagcctgtttggtggtctcttcacatggacacgtgagacagatttcgctagggaagcaaataaccatggaggtgggcaagaaatatccatgattgtagagctttcaatcagccttttattcttgtaacaaatgaaaaacaaaggattatcagacatctgcggaaaacctctaacatagaagaaggagataaaatgaacaaacaataaaaagcaacttaaaaatggacaccatataaagaaaggaaaacagtttaaaaaaaaaaaaaacccaaaaccctattcttaagctacagagaaagcctggccaacatggtgaaaccctatctctactaaaaatacgaagtattttagccaggcatggtggcacatacctgtagtcccagctgctcaggaggctgaggcaggagaatcacctgcacccgggaggctgaggctgcagtgttctgagatcacaccacagcactccagcctgggtgacagagtgagaccttgtctcaaaaaaaaaaaaaaaaaaaaaa

SEQ ID NO: 14951 - DNA, 5012 bp, Homo sapiens; identical to SEQ ID NO: 14950

SEQ ID NO: 14952 - DNA, 2032 bp, Homo sapiens
gaaagaaagaaagaaagaaatcatagacaacgggaataaaaactgcaagatacctaggaatgaatccaacaaatgcactttcttcacagatcaaagcataaactctaattgaagactataaaaggcacatgcagtgttcatggcaccatagccatggatgaaaagactcatcattgtggagattggcagttctcaaattaatctggatttattaatacacttttgattatattcccaggagagatttttataaaatgcagaccagccaaggcaatattgaagaggcgcagacggcattaagaagctgcaattgcagggcagccaggccaagaggcaccagggccctcagcgcagcagtgagcccagaagggccgcaagtggcagggtacctctgcgcactagggaaggagccatgttgctaaatggtgttgggacagctgatgccatatagaaaaggatgcagtgatacccctacctcacaccatgcacaaaacacatcacagtgagagacctaacctgtaaaagcctttcagagaaaaatcaagaggaaatcttcctaacagtgaggaacaaaaagacagattgaacaagagattgagggtaaagacatcaataggtttgactctacagacttcttcatgaccacaagaaaaatgtcacggttgtaatgtaagtggcagaataagaaaagatatttgcagtatctacgagttacagaatatatataaaaatatgtgcaactgtctgtcgtgaaaaaaaacggcaaacaccacacatcgataaggatttggggacattggcttgtgtgtgtactgccgagagtgtagatggtcacccatttggggaatgaaatggccttccctggggagatcagagtcatgcaggatacatgactggcagttccgttctaggcgcttccttctccacccgcaaggacacgtgaagttgttgactgtgacatggttcacaaagccaggggcagctcaaatgacggggttagttgtacagtggaaggtaacgcaagattaaatgagttaaccagagctgtgtgtcttgggccagataaatcctcaaagcctaacattaaagaagcaagttgctagaaaataggccccattttgacactgaagaggttttttgaaatgtggaaggcatgttacgttgttgatgagcgtgcgtaagcaggaaaacctcagcagcccctgggaggcgccctcagcccaagggacagccctcccaggcaggtgcaggggcagacgatgcttttactgtgtctaaaattatgcttctctatgaaaaaaaaaaaagagcaaacaatggtaaaatgttagcaaagttagagctgagtggtgggtacaaggattactatggtgttcctttctgtatcttaaaatggttatcattacagttttagaactgaatctggttttaaatacaggccgtcacgtgaggtgggggttgctctgctctgtctaatccccacacaaagggcagcccttgccccattctctccgtccatcccttgctgacgccagccgtcgggagtcagccccttgctgtctgaaggctgccggcccgtggcccatgccgagctcctgtttgtctcagaagaactggcttcctcaagctttgatagggccaaaaggaggaccctcatcttcaagccctaacagccttcctaaagtcacccagacctgccagttctgcccaggcgtccagacggcaggcatcttagacgtcgctgcaagggtctgctccagatggtgagcaccttagacagacgttgctggaaggcactgctctgaacggtgggcacctaacagacgttccgggaaggcactgctccggatgttgggcatcttagatgttcctggaaggcactgctctggacagtggacaccttagacagatgttcctggaaggctctgctccgatgttcctggaaggctctgctccgaacagtgggcaccttagacagacgttcctggaaggctctgctccgaacagtggacaccttagacagatgttcctg

SEQ ID NO: 14953 - DNA, 144 bp, Homo sapiens
ggtggcaggtgcctgtaatcccagttactcaggaggctgaggcaggagaatcacttgaacctgggaggcggaggttgcagtgagccaagatcacaccactgcactccagcctgggcaaaagtgtgagactacatctcaaaaaaa

SEQ ID NO: 14954 - DNA, 187 bp, Homo sapiens
ttgtttctttttttttttttttttttttttttgagacagagtcttgccttgtcgcccaggctggagtgcagtggcgcgatctcggctcactgcaagctccgcctcctgggttcatgccattcttctgcctcagcctcccgagtagctgggactacaagcgcccaccaccacgcccagctaatttttt

SEQ ID NO: 14955 - DNA, 3834 bp, Homo sapiens
cgccctcccccaaaaaaaagaaaagaaaatcgaaagtctgtactatagttttggtccagctccctaaaattttgtttagctgcaaataattaagtgggataatgcatgagaaggcatttgtaaactgcaaagtgctagaaatgctgtgaggtaacttctttcacccctctcctcactattctctgtctacagtggtatttcccaaggcattctccttgaaaccttagtctctcattatgccttcacaagaggaggagaggaggcattgctagaaaatgctgcatgcccctactggagatcggagagtcacaacatgctttagcattttaaagtctatgaaacaggccagacggatgtggtggctcacgcctgtaatcccagcactttggaaggctaaggcgggtggatcacctgaggttaggagtttgagaccagcctgaccaacgtggcaaaacatcgtctctactaaaaaatattaaaaaattagctggacgtggtggcttatgcctgtaatcccagctactcaagaggctgaggcaccagaatcgcttgaacccaggaggcggaggttgcagtaagccaaggttgggccactgtactccaacctgggcaacagagtgagactctgtctcaaaaataaaaaataaaaataaaggctatgggccgggcgtggtggctcacgcctgtaatcccagcactttgggaggctgaggtgggtggatcacaaggtcaggagatcgagaccatcctggctaacacggtgaaaccccgtctctactaaaaatataaaaaattagctgggcacggtggcgggcgcctatagtcccagctacttgggaggctgaggcaggagaatggcatgaacctgggaggcggagcttgcagtgaaccaagatcgtgccactgcactccagcctgggcgacagagcgagactctgtctcaaaaaaaaaaaaaaaaaaaggctatgaaacaatggtgaagacacctgttggatctaatttaacttagggtgtacaaactgattttattaaaatttcaaaaaaattgaattttaagcttttaacaggggaggcaaatcttgttatctgatgagaaatgtgtttggggaagagctggtctgtctccactgctgcctcctctctctcaccttcttcccctactgccctactgaaacttctctcaaaaggcattagtgaggggcctccgaattgccaaatcccaagccctcttagtctttagcatatttgacaccattggcacatttcattctaaaaatctctcccctctagcttctgtgatatactctgggtattttctctctctggctttccttagtcctttttattcttgctctgtaaattccatgacttttttttttttttttttttgagacggagtcttgctctgtcgcccaggctggagtgcagtggtgcaatctcggctcactgcaagctccacctcccgggttcacgccattctcctgcctcagcctcccaagtagctgggactacaggtgcccgccaccacgcccagctaattttttgtattttttagtagagacggggtttcaccgtgttagccaggatggtctcgatctcctgacctcgtgatccgcccacctcggcctcccagaatgctgggattacaggagtgaaaatttcataactttcgactatcactctcaaccccttctttgaagctccagtctcatattccatgtgactagcagggatcacctgggtcccccatatgcaccttaaacttagtccagtccaaagtaagcttcgcatttcctttccccagacttccaaaacctataccacccccttcattctgcaactcagttaacagcataactccctaccccagtcacttaggttggaaacctcagtcatttgattccttcttgaccccttcactgtctccctctccgccagcttatacagggggctagacctgcaaattctgtctctgtaatagcccttatgctcctattttctcttcattttcattttcactgccctaatcgaggccctcattgaacctttcctttggaactttacatatatcctctacacaatcagcaggattttcttgctgaaacacagttgatcattgctctcctgcttaaaatccttcaaaggctgttcacttacagaataaaataaaattacgtagcattttagctatgctggacaacacgttgttctattacataccactcctttccctgtgtctgtgttttttgcttatgctcatctgtttggattttttttcctcctgacagaattgtacttaggcctcaaagcctaattcaaaaggtcacttccttccctaagcctaacctacctcccaataatatttaatggtaatttcctctgtgattacccctatagaataacgtagcagttatgttatttaagggtaacataaagggtatttaacccattatgttatgctgtttgtgttgtatatgtctctgctctcaaaggctgtgagctctatgaggacaggaactatcttaatcaattgtgtattcctagcaccccatacaagtgcctggaatatagctacaatcaataaatgtttgtaaattgaattgaattgaagggacattacaacattgtagtataaatcactttgtagcctgagattgatcactactgcaaatactaaaagtggaagaacatatacctttactattcagtagaatagttttatggttaaatcaatagcatcgtgtaacatgtgatgatgtgcgtttatgcatttatccaaatatttgtaagtttaatactgaccacgatgtatatggctattgaagaaaaccacacataatatgtgtgtgaggtttgaaactagctctgttgcctagggctgtctttgtgccttgccagaatgtggaccgtggcatgatcggcctgaatatttagccatcctcatgatagcatgtggaataactggtttacagttcattcgtttcatacatactctgcctagcatgtaaaattaactggaaactgaggaattggagccaaagttagaaaatgaggagagttcaacttgaaccatcaggaaacaggctgattacatgaaggtctttttgtttgtttgtttttaacataataaatagagatggggtttcaccatgttgcccaggctggtctcaaacttgtgggctcaagcaatcctcctgcctcagcctcccgaagtgctgggattacaggcctgagccaccatgcccatcctatattttttttcaggcaatatccttttgtgctcaagaaattaagacacacaccccaccacaaactacatttgaagactctgccaaaaaaatgccatgttttttctcattttctttcatcagtaattaatgataccaagaacacttatatgcatggtttatagcagttggctatggtcaaaaaaagttgggcttcccctctgagacatttgcagatatatgtcctaggtataccatcagtggcaaataatgcttatcttaagatctaatctcacagggcatgctgggctcacgcctgtaatcccagcactttgggaggccaaggcaggaggatggcttgaggccaggagtttaagaccaacctgggcaacatggcaggaccctgtctctacaaaaaataaaaaaagttagccaggcatggtggcttacacttgtggtcccagctgcgcaggaggctgaggcagaaggatcacttgagcactagaggtggaggttgcagtgagctgagattggagtgccagtggactccagcctgggtgacagagcaagactctgtctcagaaaacaaaaaaaaaaaaaaaaaaaa

SEQ ID NO: 14956 - DNA, 464 bp, Homo sapiens
gaggcaggaggatcacttgaacctgggaggcggaggttgcagtgagccgagattgtgccactgcactccagcctgtgcaatagaatgagactctgtctcaaaatatatatataaataaataaaaaataaaaactagatggtagtggaggaggttacactaagaatagaacaacctcttcaagatagagtgaggctcagatgtcatacattgaatataccatgccgttcattcattctaagactgacttttgagaaattatgctagtagggcacagagaaataaggaagtgcttagttcagagggtgctttgtggctagcaactcctaggtctctccttacaacttagattgcaaagtaccaacaactagtatatgctgtattaggatttctagaaactgaatatcaagtctcagaccaggcacggtggctcacgcctataatccaagcactttgggaggctgag

SEQ ID NO: 14957 - DNA, 299 bp, Homo sapiens
ggcgcggtggctcacgcctgtaatcccagcactttgggaggccgaggcgggcggatcacgaggtcaggagatcgagaccatcccggctaacacggtgaaaccctgtctctactaaaaatacaaaaaattagctgggcgtggtggcaggcatctgtagtcccagctactcgggaggctggggcaggagaatggcgtgaactcaggaggcggagcttgcagtgagccgagatcacgccactgcacttcagcctgggcgacagagcaagactccatctcaaagaaaaaagaaaaaaaaaaac

SEQ ID NO: 14958 - DNA, 1915 bp, Homo sapiens
caaatgttggtttgtatatatattttttaaaaggcactagacttagaaatgccaaagtaattaattttctttattttcagaaacaatttagtgttcatggtacgaagtgtttctaaattgaaacactttcagattaatggatttaagataactggttgctcttttctataagtagtaataatgagatatggcttcagctacatatcagataccagatctcacttcctgttcctttatttcattcatccattcattcagcaaatatttgctgagcactaaaatgctccagacacagtgcatgaaccctgaagatataggcaaattgcataacccaagcaaagggccagagatgagcaacagcatggtacataccccaaactaagaacttcactatggctaggatatataatttagaagaaagaaggttaggttggggtaggaggaagcataataaattatgaatttagagatgtaatcaaattatgaagggtcatgaaagccttgtacaagattttgagtttgatctccatagagtcatataattagattaattttagaaagctcatagtgtctgcagtgtggagagtagattagaaggaagcaggcctggaagcagggagatcatttgggagacttttccaggacagagaaaatggtggtctaaactgggatggttgcaagggggatgaaaagaagtagatatttaagagaaaatttaagaatacttatttagttcaagaacgttcctgaaagaatgagcctaaccatattcttgatcatctaaggaaggtctattccttctcaaggacagctaagtaaactaataattgattctaagtgatgtaattgaacagttcaaagcagttattcgtcattagaaattattgatactggtcagataatacctactgagagctagtcccattaattttcatcataattataatcatagcatttaagccatattatttctcagcatttcctatgttccagttttatagcactgaatattttaaatggtttatattacttaatactcacagtagctttacaggtagatattattgttatttccattttacaggtggagaccaaggcttagagaagttaagtactttgcctaaagttacacaggttgtaaatggtaaagctattattggaacctagtgactttttagttactggcccagctgggattagaacccagctctatcctgtattattatttccaagacttttatttttgttggggttaattgctaatattctgtacaacttcgttttagcccagtcttgcatataatcatattttctgcataaataagataagctagagtttgagtgagcacatagtgaagaatattgactatttgtttttttctttccaattagttagggtaaagcaagtgtaaagggaagtggatggtaaggcattttgaggaggcaatcaaatatgtttttttctaattatatatttccaagccaataatttctttgaagaagaatgttttaagcgtgtttctttaccatgttaggccagtaggtacagagaaaataatattagctctttatgtcagcataggtaacaaagccttaaaaaattcacagctgaatgcaacagtgaaggccgttgacaagagaggttgcattacttcaaccagggctactgcagtgaaccaaaaaaagaactgagttctaggcttccatctccaggctacatcttaactgactaagagggcagtttagctgtccaggaagaactcgattgctaactctcactgataattttgcaacagtgacaataaagaatgaattttaaaaagaaaaacttgtctccctgaactattgaactccagaaaaagtagtacttacagtctttgctttaagagaaaccagttaaaaaaaaaaaaaaaaa

SEQ ID NO: 14959 - DNA, 451 bp, Homo sapiens
tgaaaataaattgtcaacctggaactatgtacctggaaacccatctttcatgtacaaagatgaagtaaaataaagattttcaaaaacgaggaatatttacagacctttgcgaagaagttttaaaggggtgtatttcataaaagtcccaagcaagttctgagatgcaagaatgaatatcgagccaatatactgattaaaatgtttcatataaatcatcattgtttctataaagtgataattgtaataatgtaatttgtaggactttttaaaaaaaatttctttaatttgagacggagtttctcgattcttttttatttgagacggagtttctctcttgttgcccaggctggagtgcaatggtgcgatctccactcactgcaacctccgcctcccccgttcgggggtttctcttgccccagcctcccaagtagttgggatcacaggcatgcgc

SEQ ID NO: 14960 - DNA, 423 bp, Homo sapiens
tggggaatgagaattctgctctttgcctttcctcttgggatgtgagacttttaataatcttgaaaaatgtcatgaatagccacagaaactcttagttccttttctttaaatgtaaaaaccattatccacaaggtatacttttcttcctggtttaattcagcagtttttccaattgtacctaggttttttacttacagattttaatgtaattcttatatgagttattttttaatatacatctgcaggtcactaataaggggattgtatcttcgtttggcctaagtccagcaatctgaaagttggaaggtaagaagcacttcgcaccatattcacaagttctgtttttgatcagagttgacattattgagtcagaatccagaaagcaacctcacttgtgacactgataggagtccaagggaacag

SEQ ID NO: 14961 - DNA, 2661 bp, Homo sapiens
ctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcagggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattggtgaggggcctggagagtaacgggagagagggaacagtggcgccggggggggccaggggccccggtttctaacctctccgtctctccctagcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtgagtggggacctggatgtgggggagagggacgtgggtgaaagggacgtgggttccgaagacaggaagcgctattcttagaaaccacggcagtctcatgacttcagagacgtgctcgtgggttccgaagtattgtaacttcgcttcattctggcctttcaggtgcggagctctggactgggattaagaaggggcccccacgcaaactcaaattccctgagcctcaagaggtggtggaagagttgaagaagtacctgtcgtagggagatttgggtagaagccctcatgctgaggtttgaaatgggaagtggggggcgcgaccgctgttgaggaagagaaggcattgatcttggtgtggctacaagtacccacctggcgtgggtagctcacgcctgcaatcccagcactctgggaggtcgaggcaggagtggatggccaacacagggagaccctatttgaaaacaaaaaacaaaaaaaagacacaatattgttttctgtctagtgtgccctaagtggaatttatgtcctttgggagactgtagttgacttgccctgggggtatggacaagttttccatttggaagtttatttcatgttacttcatttatgcttatccctaccctcttctgtttggttcttgggtgttctgttactgtcctgtgttaacactgcattacaataccattaaatttggttacaaggattttgaccttgtctttgtccctagtgcttcatacagtgctttggcatgttgttctgcacttattatgttgagtgagatttggaggaaggatgcaatccttgagcttcagggtttgtgagttcaagggttggggaacatgtcttcctcagtccttaagattgcccggatcctttctctaaccttatttcccttctcatttttgcagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 14962 - DNA, 2660 bp, Homo sapiens
ctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattggtgaggggcctggagagtaacgggagagagggaacagtggcgccggggggggccaggggccccggtttctaacctctccgtctctccctagcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtaagtggggacctggatgtgggggagagggacgtgggtgaaagggacgtgggttccgaagacaggaagcgctattcttagaaaccacggcagtctcatgacttcagagacgtgctcgtgggttccgaagtattgtaacttcgcttcattctggcctttcaggtgcggagctctggactgggattaagaaggggcccccacgcaaactcaaattccctgagcctcaagaggtggtggaagagttgaagaagtacctgtcgtagggagatttgggtagaagccctcatgctgaggtttgaaatgggaagtggggggcgcgaccgctgttgaggaagagaaggcattgatcttggtgtggctacaagtacccacctggcgtgggtagctcacgcctgcaatcccagcactctgggaggtcgaggcaggagtggatggccaacacagggagaccctatttgaaaacaaaaaacaaaaaaaagacacaatattgttttctgtctagtgtgccctaagtggaatttatgtcctttgggagactgtagttgacttgccctgggggtatggacaagttttccatttggaagtttatttcatgttacttcatttatgcttatccctaccctcttctgtttggttcttgggtgttctgttactgtcctgtgttaacactgcattacaataccattaaatttggttacaaggattttgaccttgtctttgtccctagtgcttcatacagtgctttggcatgttgttctgcacttattatgttgagtgagatttggaggaaggatgcaatccttgagcttcagggtttgtgagttcaagggttggggaacatgtcttcctcagtccttaagattgcccagatcctttctctaaccttatttcccttctcatttttgcagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttgacctcccaaagtgctggggttacaggcatgatgagccaccgcacctggcctgacctgcaacttttatgatctctggtaaaacatgagaaatacttgtaaaaattatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcctaaattaccagtgactggatgccttatgacc

SEQ ID NO: 14963 - DNA, 793 bp, Homo sapiens
tggggggcgcgaccgctgttgaggaagagaaggcattgatcttggtgtggctacaagtacccacctggcgtgggtagctcacgcctgcaatcccagcactctgggaggtcgaggcaggagtggatggccaacacagggagaccctatttgaaaacaaaaaacaaaaaaaagacacaatattgttttctgtctagtgtgccctaagtggaatttatgtcctttgggagactgtagttgacttgccctggggggtatggacaagttttccatttggaagtttatttcatgttacttcatttatgcttatccctaccctcttctgtttggttcttgggtgttctgttactgtcctgtgttaacactgcattacaataccattaaatttggttacaaggattttgaccttgtctttgtccctagtgcttcatacagtgctttggcatgttgttctgcacttattatgttgagtgagatttggaggaaggatgcaatccttgagcttcagggtttgtgagttcaaaggttggggaacatgtcttcctcagtccttaagatgcccagatcctttctctaaccttatttcccttctcatttttgcagctttgtgtccctggtgatgtgggaacattaatgatggaacatggccaacttcagtcatgaacctgaagccctgggttctttcctgccggaaagaagggttaggtatgaaggaaaccttcttataagggattgtaaaagtactggatatgggttaataaaaggttaagaaaagtatttggggaataaaataaaa

SEQ ID NO: 14964 - DNA, 2245 bp, Homo sapiens
ctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtggttgtgccccaaggtccgcctccaggccacgtgggtgctgcgggccaagctttcccttcctttgagagaggtttccgctgtaggagcagagcttccgggctgcgctcttcgttgcccagtttccgctcagtggtcgcgtctccgccccccacccaccagtcccgctgcattctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattggtgaggggcctggagagtaacgggagagagggaacagtggcgccggggggggccaggggccccggtttctaacctctccgtctctccctagcactagctgacgcgtctatgggcgcaacgccgcggccctgagccaggcgctgcgcctggaggccccagagcttccagtaaaggtgaacccgacgaagccccggaggggcagcttcgaggtgacgctgctgcgcccggacggcagcagtaagtggggacctggatgtgggggagagggacgtgggtgaaagggacgtgggttccgaagacaggaagcgctattcttagaaaccacggcagtctcatgacttcagagacgtgctcgtgggttccgaagtattgtaacttcgcttcattctggcctttcaggtgcggagctctggactgggattaagaaggggcccccacgcaaactcaaattccctgagcctcaagaggtggtggaagagttgaagaagtacctgtcgtagggagatttgggtagaagccctcatgctgaggtttgaaatgggaagtggggggcgcgaccgctgttgaggaagagaaggcattgatcttggtgtggctacaagtacccacctggcgtgggtagctcacgcctgcaatcccagcactctgggaggtcgaggcaggagtggatggccaacacagggagaccctatttgaaaacaaaaaacaaaaaaaagacacaatattgttttctgtctagtgtgccctaagtggaatttatgtcctttgggagactgtagttgacttgccctgggggtatggacaagttttccatttggaagtttatttcatgttacttcatttatgcttatccctaccctcttctgtttggttcttgggtgttctgttactgtcctgtgttaacactgcattacaataccattaaatttggttacaaggattttgaccttgtctttgtccctagtgcttcatacagtgctttggcatgttgttctgcacttattatgttgagtgagatttggaggaaggatgcaatccttgagcttcagggtttgtgagttcaagggttggggaacatgtcttcctcagtccttaagattgcccagatcctttctctaaccttatttcccttctcatttttgcagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaacttaatcttaagggatggacaaagccagccttgtggagttggtagtccttgtgtttttcatagcccaagatagccatgtgacctggaacttttaaaaaaaaatttttttttaagagccagagtctcactttgtcacccatgctggagtatagtggtgctatctcggctcactgcaaccattgtctcccaggttcaagcgatactcctgcctcagtctcctgagtagctgggatcacaggtgcacaccaccacgcctggctaatttttttatttttatttttagtaaaggcggggtttcaccatgttggccaggctggtctcaaactcctgacctcaagtgatatgcctgccttg

SEQ ID NO: 14965 - DNA, 2660 bp, Homo sapiens; identical to SEQ ID NO: 14962

SEQ ID NO: 14966 - DNA, 623 bp, Homo sapiens
  misc_feature (95)..(95): n equals a,t,g, or c
caattttgttttctgtctagtgtgccctaagtggaaatttatgtctttgggaagactgtagtgtacttgccttggggggtaggaacaagttttcncatttggaagtttatttcatgtacttcatttatgcttatccctaccttcttctgtttggttcttgggtgttctgtaactgtcctgtgttaacactgcattacaataccattaaatttggttacaaggattttgaccttgtctttgtccctagtgcttcatacagtgctttggcatgttgttctgcacttattatgttgagtgagatttggaggaaggatgcaatccttgagcttcagggtttgtgagttcaagggttggggaacatgtcttcctcagtccttaagattgcccagatcctttctctaaccttatttcccttctcatttttgcagctttgtgtccctggtgatgttggaacattaatgatggaacatggccaaacttcagtcatgatcctgaagccatggtttcttccctgccagaaatgaaggttcagttatgaggcaaccctctagtaaggcattgtaaaagttactggatttggtttaataaaagttgaaataaagtatttgagtaatagagtaaaa

SEQ ID NO: 14967 - DNA, 2297 bp, Homo sapiens
ggacaagagggtcacttggattgtggagttctttgccaattggtctaatgactgccaatcatttgcccctatctatgctgacctctcccttaagtgagtagtgcaaagggagggatggtggaaatggagatgctgtgccttccctctcactgtttttggcttttctttttcttttggccttgattttcacacatggtaaccaaaggcatctccctctcccctcttaaatatctatacttccactttccttgatccattattttttttcagcatattaaataatatattcttttcagatacaactgtacagggctaaattttgggaaggtggatgttggacgctatactgatgttagtacgcggtatgtaaagacctgggcagagggtctgagcagggaaatcactttgagtgatacatacagggacatttagagaactttctgggccctgcaggtacaaagtgagcacatcacccctcaccaagcaactccctaccctgatcctgttccaaggtggcaaggaggcaatgcggcggccacagattgacaagaaaggacgggctgtctcatggaccttctctgaggtacctgaaaggaagggcaggtgcatgaagggtgcagaacagtaggtgggctttcaagccctacccgggtttgattcacagctctgccacttgcccattagctttgagggtgtggactagttactagacctcatgttttaattcatttagcaaatatatattatgtgcagacctgctagtactgggtaacaatcattagttaagatttggtctcaggccaggcacggtggctcacgcctgtaatcccagcactttgggaggccgaggctggcagatcacctgaggtcaggagtttgagaccagcctgaccaacatggagaaaccccgtgtctactaaaaatacaaaaatagccgagtgtggtggcgcatgcctataatgccagctatttgggaggctgaggcaggagaatcacttgaacccgggaggtggaggttgcagtgagctgagattgcaccattgcggtccagcctgggcaacaagagactccatcaggaaaaaaaaaaaaagattctgtctcgaaggccattgcccctatggtctgtaggttttaggtcccctgtcagttattggggggtaataaccccgggcttacaggcttgtttgcagattacattaaataatttaggtataattcttggcacggtgattggcacataatgggtatttaactattagttgacttttctgggtacctaaaaaagaggaaggttagggaagatttttgtcctttgcttactccttcctttcccagactttgtgtaaaatacctcttacttcccaggctctttactctcccttccaacccagatcctgacgtgtgcatctcttttgtgcaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgatt

SEQ ID NO: 14968 - DNA, 397 bp, Homo sapiens
ctcccacctgtctttcccagaccagatgggtttggggtgctctgcagaggactagctctgcctggttttggcttgtcctctggtgttctttatttacactcctctgccgccaaagacgccggccaggggttgcaggcactgagctagatccacttaaaatgctggaaggctttgatgtacagataccaggagatggctttgagcgactgagcctgatctttctgggcaacaggtgtttgtccacagaggggtacaagctgggtggggagagcactgtaggatcaagggcagtgtcattcttgttctctctaggctcttgactatggcttgatggtgaagagtttttttcttgtggagttgggcaggctctggccttcctcttgagcagaagagtgcc

SEQ ID NO: 14969 - DNA, 398 bp, Homo sapiens
ctcccacctgtctttcccagaccagatgggtttggggtgctctgcagaggactagctctgcctggttttggcttgtcctctggtgtttctttatttacactcctctgccgccaaagacgccggccaggggttgcaggcactgagctagatccacttaaaatgctggaaggctttgatgtacagataccaggagatggctttgagcgactgagcctgatctttctgggcaacaggtgtttgtccacagaggggtacaagctgggtggggagagcactgtaggatcaagggcagtgtcattcttgttctctctaggctcttgactatggcttgatggtgaagagtttttttcttgtggagttgggcaggctctggccttcctcttgagcagaagagtgcc

SEQ ID NO: 14970 - DNA, 3369 bp, Homo sapiens
gagagaagtggagatcctgatgtttctcagtgccattgtgatgatgaagaaccgcagatccagtaagtttagttcacttctcagactcaaggttagatctaatgccctttggaggtgctttgcttcatgttaagagagtggcaatcatttggtaaatttgtcctacgtttaattccaaggctgaatttgaacttggacttctatcccctccctgtctcctatttcaaagtgccccatgaagagggacaaagaatgggatataggagtgcacagcccagcctgacctgtgacatctctgtgtttcagtcactgtggagcaacatataggcaacattttcatgtttagtaaagtggccaacacaattcttttcttccgcttggatattcgcatgggcctactttacatcacactctgcataggtgaggagactgcctttctttctttttttttttttgtaagactgtgttgatagacttgattgtggaaaccacagtcccaacagttgcaatcccaaacatgtttctccatacccttcttccatatctcatacctaatgaattatatatgtagctcagatgataacagtttacagagactgttattgtagaggtagggaatgtgttggtggtctacatatatccacaagtgtgtattatttgggggctgaaatccttgggttggtttggaagtaaattccctgtgtaaggctttttatgtttccttcgacatcttctttctgtatttagtgttcctgatgacgtgcaaaccccccctatatatgggccctgagtatatcaagtacttcaatgataaaaccattgatgtgagtgctctttcccctttctgtttcttgggtcccttgtgggtgattttgtagttgtgctctccattcactaggaggaacaacagtgcttcaaaatggatgtcacgggcactgtggttcattatgagagccgggggagagggaacaccaggatgaggaattagatgctaaagtctgaaccttcccaggaggctatgtggatccagctgacttttcttccctgtatttggcaggaggaactagaacgggacaagagggtcacttggattgtggagttctttgccaattggtctaatgactgccaatcatttgcccctatctatgctgacctctcccttaagtgagtagtgcaaagggagggatggtggaaatggagatgctgtgccttccctctcactgtttttggcttttctttttcttttggccttgattttcacacatggtaaccaaaggcatctccctctcccctcttaaatatctatacttccactttccttgatccattattttttttcagcatattaaataatatattcttttcagatacaactgtacagggctaaattttgggaaggtggatgttggacgctatactgatgttagtacgcggtatgtaaagacctgggcagagggtctgagcagggaaatcactttgagtgatacatacagggacatttagagaactttctgggccctgcaggtacaaagtgagcacatcacccctcaccaagcaactccctaccctgatcctgttccaaggtggcaaggaggcaatgcggcggccacagattgacaagaaaggacgggctgtctcatggaccttctctgaggtacctgaaaggaagggcaggtgcatgaagggtgcagaacagtaggtgggctttcaagccctacccgggtttgattcacagctctgccacttgcccattagctttgagggtgtggactagttactagacctcatgttttaattcatttagcaaatatatattatgtgcagacctgctagtactgggtaacaatcattagttaagatttggtctcaggccaggcacggtggctcacgcctgtaatcccagcactttgggaggccgaggctggcagatcacctgaggtcaggagtttgagaccagcctgaccaacatggagaaaccccgtgtctactaaaaatacaaaaatagccgagtgtggtggcgcatgcctataatgccagctatttgggaggctgaggcaggagaatcgcttgaacccgggaggtggaggttgcagtgagctgagattgcaccattgcggtccagcctgggcaacaagagactccatcagggaaaaaaaaaaaagattctgtctcgaaggccactgcacctattgtctgtaggtgttaggttccctgtcagttaattggaggtaataacccctggcttacagggttgttttgcagattacattaaataatttaggtataattcttggcacggtgattggcacataatgggtatttaactattagttgacttttctgggtacctaaaaaagaggaaggttagggaagatttttgtcctttgcttactccttcctttcccagactttgtgtaaaatacctcttacttcccaggctctttactctcccttccaacccagatcctgacgtgtgcatctcttttgtgcaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgatt

SEQ ID NO: 14971 - DNA, 3369 bp, Homo sapiens
gagagaagtggagatcctgatgtttctcagtgccattgtgatgatgaagaaccgcagatccagtaagtttagttcacttctcagactcaaggttagatctaatgccctttggaggtgctttgcttcatgttaagagagtggcaatcatttggtaaatttgtcctacgtttaattccaaggctgaatttgaacttggacttctatcccctccctgtctcctatttcaaagtgccccatgaagagggacaaagaatgggatataggagtgcacagcccagcctgacctgtgacatctctgtgtttcagtcactgtggagcaacatataggcaacattttcatgtttagtaaagtggccaacacaattcttttcttccgcttggatattcgcatgggcctactttacatcacactctgcataggtgaggagactgcctttctttctttttttttttttgtaagactgtgttgatagacttgattgtggaaaccacagtcccaacagttgcaatcccaaacatgtttctccatacccttcttccatatctcatacctaatgaattatatatgtagctcagatgataacagtttacagagactgttattgtagaggtagggaatgtgttggtggtctacatatatccacaagtgtgtattatttgggggctgaaatccttgggttggtttggaagtaaattccctgtgtaaggctttttatgtttccttcgacatcttctttctgtatttagtgttcctgatgacgtgcaaaccccccctatatatgggccctgagtatatcaagtacttcaatgataaaaccattgatgtgagtgctctttcccctttctgtttcttgggtcccttgtgggtgattttgtagttgtgctctccattcactaggaggaacaacagtgcttcaaaatggatgtcacgggcactgtggttcattatgagagccgggggagagggaacaccaggatgaggaattagatgctaaagtctgaaccttcccaggaggctatgtggatccagctgacttttcttccctgtatttggcaggaggaactagaacgggacaagagggtcacttggattgtggagttctttgccaattggtctaatgactgccaatcatttgcccctatctatgctgacctctcccttaagtgagtagtgcaaagggagggatggtggaaatggagatgctgtgccttccctctcactgtttttggcttttctttttcttttggccttgattttcacacatggtaaccaaaggcatctccctctcccctcttaaatatctatacttccactttccttgatccattattttttttcagcatattaaataatatattcttttcagatacaactgtacagggctaaattttgggaaggtggatgttggacgctatactgatgttagtacgcggtatgtaaagacctgggcagagggtctgagcagggaaatcactttgagtgatacatacagggacatttagagaactttctgggccctgcaggtacaaagtgagcacatcacccctcaccaagcaactccctaccctgatcctgttccaaggtggcaaggaggcaatgcggcggccacagattgacaagaaaggacgggctgtctcatggaccttctctgaggtacctgaaaggaagggcaggtgcatgaagggtgcagaacagtaggtgggctttcaagccctacccgggtttgattcacagctctgccacttgcccattagctttgagggtgtggactagttactagacctcatgttttaattcatttagcaaatatatattatgtgcagacctgctagtactgggtaacaatcattagttaagatttggtctcaggccaggcacggtggctcacgcctgtaatcccagcactttgggaggccgaggctggcagatcacctgaggtcaggagtttgagaccagcctgaccaacatggagaaaccccgtgtctactaaaaatacaaaaatagccgagtgtggtggcgcatgcctataatgccagctatttgggaggctgaggcaggagaatcgcttgaacccgggaggtggaggttgcagtgagctgagattgcaccattgcggtccagcctgggcaacaagagactccatcaggaaaaaaaaaaaaagattctgtctcgaaggccactgcacctattgtctgtaggtgttaggttccctgtcagttaattggaggtaataacccctggcttacagggttgttttgcagattacattaaataatttaggtataattcttggcacggtgattggcacataatgggtatttaactattagttgacttttctgggtacctaaaaaagaggaaggttagggaagatttttgtcctttgcttactccttcctttcccagactttgtgtaaaatacctcttacttcccaggctctttactctcccttccaacccagatcctgacgtgtgcatctcttttgtgcaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgatt

SEQ ID NO: 14972 - DNA, 313 bp, Homo sapiens
ttatgggagcaaagtaaataatttattttttaaaaaagcaactgtatctttttcaacttactttttggaagtaatgatggaagtacatcttcttggcccctgcagaggttttagctagacttcctaatactggcagtgaataagccccacgttgggtgctggacagcatccatcactcccacccacttagtattccacccaacactgcttcacaccttcctctggaacattttcttaaacaataccccaccacagaggagggtgttctttctcagcttttcttaaattaccagtgactggatgccttatgacc

SEQ ID NO: 14973 - DNA, 398 bp, Homo sapiens; identical to SEQ ID NO: 14969

SEQ ID NO: 14974 - DNA, 1214 bp, Homo sapiens
aaaaaaaaattctgtctcgaaggccactgcacctattgtctgtaggtgttaggttccctgtcagttaattggaggtaataacccctggcttacagggttgttttgcagattacattaaataatttaggtataattcttggcacggtgattggcacataatgggtatttaactattagttgacttttctgggtacctaaaaaagaggaaggttagggaagatttttgtcctttgcttactccttcctttcccagactttgtgtaaaatacctcttacttcccaggctctttactctcccttccaacccagatcctgacgtgtgcatctcttttgtgcaggagaatgtgatccgagaatttaacttaaatgagctataccagcgggcaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgatt

SEQ ID NO: 14975 - DNA, 3370 bp, Homo sapiens
gctggccgaggacctgaaggtgcagctggagcacgtgcagactcggctgcgggagatccagccctgcctggcagagagccgggctgctcgtgagaaagagagcttcaacctcaagagggctcaggtgtgtgcaggggtgaggggccaggccagggtggtccacggtcacggacctatcctgggggcaagcggctcaaggttgaggacccttgcccttagccaggcctctcctgccccaggaggacatctcacggctgcggcgcaagctggaaaagcagaggaaggtggaggtctacgcagatgccgacgaaatcctccaggaggagatcaaggagtacaaggtggggctgtgggccaagttgtgccctatccacctgagaattgtagatgcaggattgctgagactagtggagagtctggggaccctggaagtaatgtagggcagcagaaagtgggcagcacagtggtcacagagtcaaatgctgtttgctgtacatgtactgtgagccaggcacagtgcttggctgggtgtgggttgggaggctaggaactggccctggtctctgacttcttgaaactgacagtcaggggaggaggcagccaagtaattctctcatcccagatgtgtaatatgatggcagaggccagaggggctgaggggactcaggggaggcccttcccctggccctggggtcagcaggcttcctggagtgaatgtcaccacagcagacctgaagaataggccagacgtggctgtgaggaacgggagtgagtagctttaggcaaagggaacagcagatgtggacgcttgagcggaggggttgctgggacagcaccggaggttgtaatcagaggagccaatgtggagaggttgggccgtgtcccctccctgaagagtgcggtacgccaggttgagacctcaaagggttttaaacaggagagtgatgtggttagatttgttgttggttttgggctggaagaggtagactggaggcagggaaattgttaaggtattgctttcactgaggccccccccacagtagatgggttcaggagacattcagaggcagaattgcttggactcgggggtggatcgaatgcatggagtgagggaaagggaacacttggaggactcctggtttcctggtttgagaaactaggtggatagttagtaccatttagggggttaggaggcctgcgggggagcaggttctatgggatggtgtcaaaggatgctgagaaggtgcctgtgggacccctttgggaggctgggaaggtgctcaaggcaaaagggccgggctggagaacaggcttggggaatgtcagtagaggcagaggtggaagccacatatgacttggtcatcccttggaagcagttgagccttgaagggcagaggcagctggaggcagccatggggtagaggcaggcttgggagcctgttcagtgctggtgtgtagggtcctgggagacaggagtgatggcagggaggctgctgaggcggcaggctgggctgggattttagcaggctggaggagcactgttgggggatgctgagttgagtcaatccatgtctggagttggaggtgagaccctcctggtggcggaagagaggtctcaggctaagaagggacccacggcagggtctctggccagtgtcgaggctgggcccagttgagggtagagagaacagatttctagttgcattgccattccagctgtgacttagcaagtgcaggtgaagaggtagacaagattgggatttcaccagaggcggccagtggggcaggagatgaagccccaaggcagagtccaggctgggcctgtgggtccttgtccttttgaggggacacatgatagccatcactgcccagtgatgaatccggactctgctgatttctagtgttgagaccttggcctctgcacctcagtttgctcattcatagagtgctcgtccttacctccagggttatgggaggatgaggtgcagtctccagtgtggtgggcttggcctggactcctcctgctgtcagcttggggtctgggcactgtcagagttgttcccaagctgatgcctttgcctggcccaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggatgaaggaggtacccttttggcagatgggggcatcacttgcttcctttgggaagctttaaggttgctgcagtcaccttcctcatcttgcaggtgcctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaa

SEQ ID NO: 14976 - DNA, 789 bp, Homo sapiens
aaaggccggcctgaactggatcctgcggaccgcttctcagcggcttcacccccacaccactcgaatgcacagatcgggacacctcagctgggtgacttccctcgttgcaatcggcctcgggagcggtgcggcgtgtaccgagcggcgcccctgggctcagcgcgctgcaggcgccccgggcggatccttcaccgaggcaggactggggctggcgccagagccggtgcggagcggtgttggttcaggcgctggcgacagtgctatggccacggcaggggccgcgtgcgtctcagcggtggcgccttcggaccctattggcgcccgggacttaagcggggccgccgctgctggaccaggacgaactggagaaggagacgcgggccgccacggtgacctcgggcgtagggccggcggcggcgggcacgctggtggaagcgcgggccgcggcaggggaggacatcgggccgcagagaaagtgccgatggcctggggcagcggtgcgagggtgggaaaaacgcaggatattgcatcatagagacgcggccaccttcgcccctggagagcgccagtctcaggagcgccgcaccggtcacgggtggaggtcagccaggcctccgtaagcgcggtccccttccaggagtagccttcgcctgggctcttgagtagatgccaagtaattccgcatcgtctctctagatatctgcgctaaaggccacccggtctccttatcagaggggcaaaactctcctcgtgggtcttcatacctaataaaagtcggcatcaaaccac

SEQ ID NO: 14977 - DNA, 157 bp, Homo sapiens
tcatgaggtcaggagatctagaccatcctggctaacacggtgaaaccccatctctactaaaaatacaaaaaattagctgggtgtggtggtgggcgcctatagtcccagctactcgggaggctgaggcaggagaatggtgtgaacccaggagtcggag

SEQ ID NO: 14978 - DNA, 4687 bp, Homo sapiens
gccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaaggggtgagccccagtctccagtccggggtcccctccttgtgtccagatcgattccctcctgaggtcttttcccatcattccccttcttctacggagcactcatctagacaagtcaagagtcactccataaatcccagggccacccactttcttaactcccatgggaatttctcgtggatgacaaatttgcttgtgcagtttctgctcttttgagagccccctcttcacttccaggcacacctaggcccaattcacccttgagaaagtctaggtttttaccaaatacaaatatcacaggttttgtctcttctttttctccactttaggaatcagcttagcatagtgagcttgtaggaatccggatttctttccacctcaaaagcaagagtggtgaaatctgatactttgttttgtttgtttgtttttttaatataggatggcaaaagctgtgttgaaagatctggcctgagagtagcatgtgagttccagtcctagctctgtcactaatcctttgaaggagtcatttctcctcgctgggcctcagttcccttatgtgtaaagggaaggaacaggacaaactagcacataaggtattttgccagaagtaacatagaccagccagaagtgcaaagggtagactgctcaattattagaactagaaaggaccttagaaagagattgcctagtattagtgtcctctgagcatttagcatcactatgacctaaacttatttagggaagagctgttgtggccacagaactgatctaacccaaaggcacaagtaaatggcttacttgttagttataacactggcaggataattgagagctgacagctaaagtcacctgcgcagcactgggagatacctacatggaattatccaaaattcttttcaattgaaaatgatcctggaaatggattaatgtagagatggccctgttttattttggtagaaagaagggctacacccctcttgatcttaacccttcaacctcagctcgtggatcattgtgtttgtgaaaccttttcttctcagattccaaactatacctccatgagctcctagaaggcagtgaaatctatctcccagaggttgtgaagcctccacgggtatgtaagggatatgtttgtgagagtggttattgactgagttgggcttatccatgatacactgaacttataaatcaacttttaggcttgaaaaattgtttttgaaatctttgggatctgggggagccagatattgtcctccccatcagctgtttggaaaattgagatcaaaaaaaaaaaaaacagtttcaaagcactggagttacgactagtatgtgggtctcctgatacctttagcagtgctttacccctggaaccaatgattgtgatgtgctttctaacaagctgggaatatcattcttctcatttgatttttctgcttcagaacccagaactagttgcccggctggagaagattaagatacagctggccaatgaggaatataaacggatcacccgcaacgtcacttgtcaggtaaggacatgctcttcagtacgtggtctaggtagcccctcagagtagggccctgcagtggaagaagatacagagtttagaaaaaacatggaaacttggtttctatactgttcagggaccataggaagtctgcatacaaacaacacagttcccatctcattcactgagactctgggctgagatggtgaccaagttttaaacgtcatagaagtgggagttagccgggcacggcgctcatgcctgtaatcctagcactttgggaggctgaggtaggtggatcacttgaggtcgggagttcgtgaccagcctggccaacatggtgaaaccccgtctttacaaaaaatacaaaacttagcctggcgtggtggcgggcacctgtaatcccagctactcgagaggctgaggcaggagaatcacttgaacccaggaggcggaggcagaggctgctgtgagccaacactgcaccattgcactccagcctgagcaacaagagcaagactccatctcaaaataaataaataaataaataaataagtgggaatgaatcttggaggctttttttcttcttcttttttttttttgagatggagtctcactctgtcacccaggctggagggcagtggcaggatctctgctcactgcggcctccgccttccaggtttaagtgattcttatgcctcagcctcccaagtagctgggattacaggcatgcaccaccacgccaggctaattttttgtatttttagtagagaccacgttggccaggctggtcttgaactcccagcctcaaggtgatcctcctgcctcggcctcccaaagtgctgggattacaaggtgagccactgtgcccagccattcgagcatttcttctgacagggctccctactactctatggcatgctcctaccctggaacaggagagtagatgggtactggcagcctatgtcctctctccgaaatgcctgctctgtagtccagaaaagagtcaaaatggttccagacaaaagaatccatggggagggcagagttaatatgttggggaatagagagggctgagccagactgtcaatggatgctctctgagctgcttctattctgaatcatcttctttttctttttcccaggatacaagacatggtgggactctcagcgacctgggaaagcaaggtgaggtactaggagatcaggcttctaaaaccttttcctgagatgggtcatgacactcaggcttgttgtttgactgaaacccagttggtgggggagccatgagataagagcacctcctagagaatgttgaactaaaggtgccctctctggctcctccccaaagtgagatcattgaaggctctggtcatcaccatcttcaatttcattgtcacggtggttgctgccttcgtctgcacttaccttggaagccaatatatcttcacagaaatggcctcggtgagtaggcactgggcagggcagggtgccctggtgggggtgttagtgggtaagggaggacgtatgtgaaagtgccttgcacaggttaggtattgaacagatatttatgccattaataaggggagcattagagctttccagcagtcacgggaggttaggtaataaccccaggagaagccacattctcttttcttcccctcccccaacttagagggtggttggggggctctccatcctcattaaagttgctggggtacagagctggttgttggcctgcatcccttaagcctggttctccccatctccagcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggtattcctattttaactcctgtgacaacacaaagcatagcgatttccatagttctaactgttcagggtctgctcctcctggtacactctttttggttcactgtatgtactcctgttgtctttttttttttttccaaagcacttttctgttttcataaattatatactcattcactcagtggacacttcctctacaatgtttgccagtttctgttagttgggagaagtgtcagctgtgaaaagaaaaagtaggtggcattttacagtgtttccagtaacctgag

SEQ ID NO: 14979 - DNA, 1032 bp, Homo sapiens
agctgacatggtagcgcacgcctgtagtcccagctactcaggaggctaaggtgggaggatcacttgagcctgggaggcagaggttgcagtaagctgagtaagccaagatcatgctattgcactctagcctggatgacagagtgagaccttgtctcaatgaaaaagcagggggcactgggaggggagaaccaaatgccctatcctccagttctcagcatatagaagggagctctctcatctgctagccactcctgcctcactgtgccatgctttctgtaatgcactctgggtccagggactgcttggcaggaggtgggaagaacaagaagtttagggccttcccagtttcttagggcctgtctggagagggaactagcgtttactgagtttttacgatgtgttacacaccatgtaaagccctttacctacattatttcttataccccaaacagagagcaaataagtatccccattttttagtcacatagagttccagagttgccacagttacatcgcaaagtcaggatttgaatccagtgcagaccgcaaacaccatggttttctctccaaagcagagcagctccagaggtggaggtgactggaatgtcctagattcagtgggaccaggagctgggggtgctagcagaggctctcatctccccagggtcttgtcagtcagagtcctaaacccttcaattaactatccctctaatcccagctgaagcctgggtaatacctcccaccaagaggtatctgtgtggaacctggccctatttagggattaggtgatggagataaatttccatggcaaacggccctcgtccccgttcgtttgcagagcacaacaatccagattaaggtacagagtttgggttttatttggagattagttggtattacaggtgatggtgataccaaaacccaatgctgctatacctgcctccatcccagatctgtcaggttgtctccacagccccacatcagagggcatccaatctgatctttgtgaaaattaaatcaacataagcccca

SEQ ID NO: 14980 - DNA, 21833 bp, Homo sapiens
tcgacgagcgcaggatgtgagctcacagcttgggactgctgaggggcaggcggctgcaggctaggggcggctcggagtccgctggccacccagctgagaggagaggcgcccccggggacggtgagagccgggcccgccgatgccctcggggaagggatggacggcccctgctggagtagagcgagcccggccgggtcctgggggaaaaggcgcgggcggcgtaggggagatggagagctccgatctcccacggagggtgggcgtgagaaccggtgtgggtttctcggtagtgaggagtggtccgggctagagaagagcccacaccggccacatttcccaggactttttgggtgacgcttaacctttacacctagggtttctgctagatccgccactctagccctcagctttcctcccgccgtcctccgtgtctgacggatttctgggtccttcttccttttagacccctcctctttccacctccgcggctgtttgccctttgttgtgcttgggttcccattagcttcgttgcgtgagccacggatccgcccttagccccgggcatccccaaatatccacacacaaagtgcggaaggaagagcactgtggctatcagtggaaacttcattctcactggaattactttctggggcgtcacctgccacagaattcctggaacccattggtctgggcggaatgtgattgacgtcatccaggggctcaaagcaattgctttgtaggaaaggaagagattagctctggatccgccgacctctcttggcaggcctatcctttgagctcctttgcattggcagaacatgtatgtgtgctttctctgatcctgggaaaactaggactagacacaaaatacacagggaacttgctaatacctgttagagaggtggatttattcctttgaggtgggcgggaaaagggaaggtgatctcataccattctagtgtttcttagtcattggcaacctcctggtgagggctcacctcccatacccaacccctgtggcaaatgaaagagtctcccagacaagccgccaaaggaattcactgcttcacacagcacccacgctggctgtccacttccttggacattcttcccagggacttacctaaatcttttcagggacaatttcagtctaacaaactgacgtatgttaaatacttaaaatgtgcatggcattgtgctgagcaccattaggggaacacagcggtaaacttgggaaaccagtgccctgcttctgggttgcacttacaaggcatgagcaactgtaaactcctgcatgtgatgagcattcggtgaaatcattccactttttttctgtctccattattaccaatgtggtccaggctgccatcatctcttcttgcctagactactgcttcctctggtcttcccactttctctcttgcacctttacaattcattctctacccagcagcaagttatcttttcaaaatacactacaagcaagtcagatcatatcactcccctgcttgcaaccctccaattgattcatatactatatagcaattagtatgaaatccacctttgttatcatctaacgcctgccttccctgacttgacatcaaaccaacttccccctactgtctgtgcaccagccattatgaccgtatttctgatcctcaaacttgttttaattttgtcattgttgagatgagatttccctatgtcacccaggctgactttcccaggctcaagcagtcatcccacctcagcctcccgagcagctgggaccacaggcatgagccaccatatctggctaatttttttttatttgtagaaacaaactctcactatgttgcccagactggtcttgaactcctgggctcaagcaatccacccacttcggcctcctaaagtgctaggattacaggtgtgagccaccacacccgccccctaaaacttgtttctaacaggaactttgcacttactcttccatctgtctacaatgctctcttcaaacctcagctgaaatgtcaccatcccaaagatgcttttcctgtccctttgtctaaattagtgcctctccctaatcactctcatatcactgttttattatctttattgcatttatcaggttctggaattatctgcttatttatttaagtccttgttgctagtctgtttccttccactagaatgtaagctccatgtggacatgactttctatatgtgttctcttctgagtacccaatgcctggcacgtaggggtacaataaatgctagctttctctctttttaaaaattcctgttatgatgcttctttgaactgtttgaaggcaaagacaatattttttcattgttccctactgcttaacatagtaggcactcagtagtttaattgctgaatgagttaaatgagctagtacatattaaatgccaagagatggggtcttgctatgttgccaaggctggtcttgactcctgggctcaagagatcctcccacctcggcctactgagtagccaggagtacaggcaggtggcagcacacatctcacctcattgtttttagatttatcctctgatcttttctagtcctttcttctcccattcttattgggagggaagaggagagtagggctgggctccctctcaggaaaaagaaaggaaaacagccatcctatagctgttcttccctgaaaaatggtgacaatttcaggaacttgggacaaggctggtgccaagaaaggggaaggtcaggaagccccagccgaagcccaggtaacctgcaccaagaacactggccggcacccccgaccctggcttactgcattctctcctgaagctgcttttactttccttcctgaagccagactctcggtggtgctcaaaataaacactggcacagactgctctggaggctggaatctttagaaaggaagtgcatcctgtccctctggctcctgggaaactcctagactggctggattcccagtaggtttggttggaagtctgggatcctgggaaccttgacaagaaagtaactggaatctgactggtagatctctagggtgatctgttcctctggccctctctaactggttccatgggtttgcttgtcttcctcgctgccctgagtggagctgagtctcagggaggctgatgaggtgaccagggcaggagtctgggagactgcctccagccctggttcctgctatagtaaaaatggcagggaggccagacgcggtgattcatacttataatcccagcactttgggagactgaggtgggcggatcgcctgcgctcaggaattcgagaccagcctgggcagcatggtaaaaccctgtctctaccaaaaaaaaaaaaaaaaaaaattagctgggtgtggtggtgtgcacctgtggtcccagctactcaggaggctgaggtgggaggatcacttgagcctgggaggcaaaggctgcagtgagccgagatggcaccactgcactccagcctgggtgacagagtgagaccctgtctctaagaaaaaaaaaaaaaaaaaagaaagcaaaatggcagggacttagcctctgccagggagcagtgcttgggcttgtcagggagagaatgagtacggtcgtgtttctgctattgtctcctcctgggctgtctcagctggttcgtgtcttctcttccctctcccatgtacagcactgagattatgaggctctggcctccactggccactcactcgtgaccctttccaccacggcggagccttccaagcctacctcctgccgtgtggtgatctacctgcagcgggagatgtcgggggacacctgcctgtgcccagcctcaggggccaagcccaagctcagtggcttcaagggaggagggttgggcaacaagtatgtccagctcaacgtgggcggctctctgtactacaccactgtgcgggccctgacccgccacgacaccatgctcaaggccatgttcagtgggcgcatggaggtgctgaccgacaaagaaggtgaggcactggggctgccgctcggggtggggagggcaggaggagttcccaaggaaatgaccagatctagaattcagtcacttttcctcttcactttatgtagggtgtcttcacctggagtccctagtagagcttcagaattctgtgaaattgtatatggaatgctgtgtttatgcattttccaggaagaagagccatacttttaaaatatttaaataggacaagattctcataggagccgtcaccttaagactgggcagcgggcagaaggccggcagtggctggtggtttctgtgttgggctgggcctggtaccctgagcctaggcccctgtggcttctacagcctggagggctgtatcccccgtgggatgtgccagttctgggtttcagagaggaagggtgaagagcagccatgggcctgagtgctagaacctccatccccgcctctgtcaccctgcgtaagggctttgtgctcgtggacccccttccctgccacctgccgccagcttgtcaggtggcctttgcctgcctcggaggtacctggcggcaaactaaccctgtagggccttctgcacccctaggctggatcctcatagaccgttgtggaaagcactttggcaccattttgaattacctccgagatgacaccatcaccctccctcagaaccggcaagaaatcaaggaattgatggctgaagcaaagtattacctcatccaggggctggtgaatatgtgccagagtgccctgcaggtacatgggtggggcggagcagggcgggcagatgaggtcaggagttgcccccttcttgtgggatggaggactctggttcctggcaggttgtgtgggaggcgtggttgatgagtgcaaacctaatgagacaagtgagatgccacccaggcccaccaacctggcagccaggtgttcacacttggcagcgtgagtaggccctgcttctggtttctatgctttgctacccggattttagggggtttttctgtttttgcttttgtttctgtttttgtttttgttttttgagacagggtttcactcctgtcacccaggctggagtgcagtggtgcgatgtcagctcactgcaacttctgcctcctgggttcaagtgattctcgtgatttggccttcagagtagctgggaatgccagcatgcgccatggcacccagctaatctttgtattttttgtagagatgaggtttcaccatgttttccaggctagtctcgaactgctgggctcaagtgatctgcctgcctcagcctcccaaagtgctgggattgcaggtgtgagctaccgcacccggcctggatcttgggttttctaactgggggtctgctttccagctggcagtttctattgtcaggggcctcatgatctgtatctgacacttcctcaccaagcagcgggtggccatggcagaggggctccagaggtatacctcgataagcctgggaagcagaagatcctaaagagggttctctgttctgtgtcgcacaggacaagaaggactcctaccagcctgtgtgcaacatccccatcatcacatccctaaaggaggaggagcggctcatcgaatcctccaccaaggtaccaggacctctgaggggtgcgggccggggatgccagtcccctggcctggcccctcactctgaactccttcacagcccgtggtgaagctgctgtacaacagaagcaacaacaagtattcctacaccaggtagggtgcgtcacagggctcaacagacactgggcagcagacccaaggagtactgcctgtactcccagcacggtcggcgtgggtctgggcctgggtcttggaactggctgtgccaagttggggaaaaacagaaagtagaagggaaattgggacagaggcctttggaactcagcagggtgccctggctgggatataaatgattgaaggtgaaatgcgccctcaacgtgtatcacgaaggcagcatggcaggtgttttcacacgtgtcatcctaccgggtggaggggatgctaggaggccggtgagctgggagtcccccaagccagcctgtgcagttcacactgggccgattccctccccacaccctccaggccatgtcctctccataggccacagttaggtagacgcaggtggctgcaggttcagagtcccaaaccctccctatgattccctgtggccaggcatattgccactgtcacccccacagtaagggaaggaatgcctcccactgacatagcagccttgtctccttccttccagggttagtgaggggagacctccttcctcagctgtccctactttgacttaaaaccaactgagttccttttcctcacaggccccccaacccagagggtaccctatgatcctttctctcctggccccctggcatcttgctttcatttcggcaggacaggatgggggaagggagggaggggagggccccacttgtctagcaccctcccttggactggaacctcactcccagccgcttggccctcatgtttttttcagcaactctgacgaccacctgctgaaaaacatcgagctgtttgacaagctctccctgcgcttcaacggccgcgtgctcttcatcaaggatgtcattggtgacgagatctgctgctggtccttttatggccagggccgtaagctggcagaggtgtgctgtacctccatcgtgtatgccacggagaagaagcagaccaaggtgtgggggattgcccctgcctgggtaggggaggacacacacccactgtgcgggggacgtggtcgggctgtgaccagcacggagcaaaaggggcatggacttggctcttttttccaaacacggtaatggtgctgggcaaggacaaggccagaacaaggggtgtggggaatggacgggaactgctttgttcctgacagcgcagggcaggggccgttgaccaccaggaagtagcctagtacagtgggaaggactgggtctttgaagttggcccaattcaggtttgaacgctggctcacaccacttgccagttttctgactttggataagccacttaagccatctgggcctcaggttcctcatttgcagacatggggatgatagtatgaatttaacgagatatgaaaatgatacaactctttggagcagcagtgtggtgtagaaacagcttgggctttcgtgttagaatgctgttcagatctcctgtctgagccagggacacaggtgggcacagcacttgagcccaggagttcaagaccaccctggacaacatggtgaaaccccgtctttacaaaaaatagaaaaattagccaggcatcgtggcacatgcctgtagtcccaagtactcaggaggctgctgtgggaagatcccttgagcccaggagtttgaggccagcctaagcaaaatagcaagattccacttccaaacacttttaataataataaaataaaatctccttactggccccaaccagctgggggtttctggctaatcaacttagtgccaggtacacaggaggcatttgataggtgacagtcatcacaaactcaggtggcccctctcccccaggctgcagtcagttaccccagagagtagctgcctcctgtgagtgcaggtcctggagatgatacgctggggtggatggcaggtcatccaggaagggccatgtgggtgtgaagagctcaaagtagccagacttgccaagcaacttgtcgacccccaaactactccaggtgcctccagctgggagatctgcagagggtttggggaaggccaacttacaggtggccctgcttccttctgcggtttttggtgtaggggtgggagggagggcgacaggtggttcctgaccctatcggtggtgaaagggttcaggggcaggtctccagtggctggtgatgctgcgacggaagtggcagcgcacctggcatcttcttaagtgtgttgtctttcatgaactcgtgtgacccctcacaacatgcctgtgagacacgcagggctagagccactctccccatgtgacagatgagtgaacagaagctcagtccaacagagcaggtctggctagaattcaggtgcttgactgccttccctttctccttcctccaggcaggtcatgccggtgacacactgcgtcaggcaggcagagaaaggcagcataaccactcagcatagcagctgctctgtgtatgcctctgcttggtggtttgctgtgtgccaatcttctgctaagcaatcacatctttcccgtaatgttgacagcaactctcaggggttgagctgaaccaaccttttgtacatatgggagctgcagcccagaagggttcagcccaaggctccacagctagcaagtggtagagctgtgttgggacctagctctggcccaccctctatgcccactagtcccttggtctcaggctggggcaggggtgtggaggatgttggtcttccctgtcctcatgtctgtagagtacatcccctcaccccgccttcggagggaggctggctttccctggagacggaccgccacctgttttatgagaggtagcggaggccttatggagcctcagggccagccgctctgacgcatggcttcctcttgaagatgaaaccttgctccaccttcttcctccctaaccccaggtggaattcccagaggcccgaatctatgaggagacactcaacgtcctactctatgagactccccgcgtccccgacaactccttgttggaggccacaagccgtagccgcagccaggcttcccccagtgaagatgaggagacctttgaactgcgggaccgtgtccgccgcatccacgtcaagcgctacagcacttacgatgaccggcagctcggccaccagtctacccatcgcgactgaccagaccctcagggagtcagggcacgggaggccctatctcccatcctgtggaacccgccccattggccaccccatgctgctgctgcctgggtctctgctctagcacccagaggcatgacaggccctgctcagaggtcagagggtctgggcagaggagggaccacattcccctgccttgcccctgagcacttctggagactgcgtcctgtcctatctgctcaccatcacccttcctgcccgacggagctgcttctgctccctggggcatatggactgacccacctcctgctgagaaccttcccctaggccctgtgcagaaggctactgccccttaggcctcagctgggggaaaggcagttctggtgctgtagaggccctggtgcagaaagtgggacgtcttttttcctaaggtgtttaagcacaggcttgataagtttggtttttaaaaaataatctaggaaatgaataattctaaatctagtaatgaggaaactgagcatttcttttgccctccagggtgccaagaccctacatatgacagaacccttggcccttctccatgcctgtgggatctgtttctttaaagcactttgtactgttattcaggaggttgataatctccttgacccatgtctttctaccctaatccccacttccctgcagaatcaatctgagggaggggataaagaggaagcaataaaaaaaaaacatccgacagagcagctctggctttgcagcctggccagcagctcagagtgcaccgaggagggaaggatggctaagctgggaccggcagtcctcacagggtgcctgtgagaaaggacattttacccccacatcatagtcacatcactgactcctaggtctagcacgactgctctttgtgattctcttgagtacccttggcttccagccatgctgtcctcacatacggtaaagccaaagagctgtcacatgggccagaaacatgagccacggcaggaagaccgtggagcccgtgggcactgcatggtgttggctggcatgcccatcagctgaggacagcaaactcccagcagcccctacagaggtggcacatgcttggccacacatctactccctgcccacaccatctatgctcttggttggtgctggctgggatggcggttctgcccagtggtgtctctgagcgcgggatgacaggagcaaccgaagcaccctgaaggccttcactccttgttgggtaactcagccatggagatgccaagcactagccaggaggtgagttcctctttagggctttggttttcattcctttttgtttggcttggccaaaccagaattcagcttatctgaattattttccaaaggaatgctgtcagggagggactgttctgccagcctaacaaagcaacgtagccacgtatagtacccactttctgctctttggagagaacacaggttatcaagttcatctctcttgactactcttatgatagctgatgccacagagcctatgggcaaatgccagacccagggttagacacaaggacctgaagtgacatgacggcgggacaggggaaatgtgactttctaattaggcattttatgttagtcacagtcttgaatgtataaacagcactaagactctcaggtcaggtaccttggtgatcagctactagttcttccagccctcattgaggtaacaagataaagacaaatccacttctttggccaaattcaggctttggctttatgactttcccacagagactggaatgcgtcagcctgagaccactggcctattttctcagctgccctcttgaggtcctttaacactcaaattcccagctccccactgaggtgttgtgatgcttgccttttgacctccccatcccctttagtccctgcttactactttgacattcacatcctcagtgtctcagtcttttttgccgagaaagcacagtagtctgggactgggcatttatcttctctgactgaaaatctctccttggtcttaaggaaaatactaacattgaactcactgacatgatcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttcctttatcacataactgtaatatttggttgctcagcataagtgatggaagcaaacactaatttctaataaaattgtgttaaactcaatggtacagagccatgtttacagtgagcaggccttgaccagcttgcggccatgggctgagttcctgtgcttctgtttatcatctgaccttgtgttctagccaggtcgtaagcgcgactgtactgttgccctgcaaccccagctccccctggaggactaaggacaagaataacaagggctggaactgtgatttaatattaattcaagaaaactacctctaacaatcactgcagtggcggaggaaaagaaatcctaagaattggggcaagatgcagcacaattcatctctggctcttggaaatctgagagaagctcaggaagtagcttgacttagtcatcaatccatacctaaagctgctcctcagccaaattcctgcatttgtggtctggatgcttggcagagtcatgctgagggctggcacacccattgctccaggaaacccgactggcttgcctccctcctctcctgggcctagcgaggccagaaatggcaatggtcggtcagtgctaagagccaggccactccgaccctgacactggcctccctctctgcatttggcagaaggtaaagtgaacaagagtccagtccagcacccccgccaactagctgagaggcacagtgaccctaggagatgtccagccagcctccaggctgagagggaaacaggcacatgccctaccaggggggcagctccctggaagggcagcaaagaaagcagtcaagggcgcacactgggtcagaaggggagcctgagactctgggagcagaaatggcaagggtggccaagcgtgcactggtttactgatcaaacctcacgtgacaggccaggaaactcctccaggcctgtggcagctgaacacagttccttggtggagaggtttactggaacatggtgtaggcagggcttatgaggaggccagccttggaggtgtcccacatgggtcttctgaagaaaagttataccacccctccccacaaaaagaaccccacaatcaaattaagagacccactgtggcccatgatggggagagaagagttctgcagcaattgtgggatgagagttgttcttcccggtgaccaagcctgggcacttggggcctcagctggcctaccagtgaaggcctgagggtggtgtcttctcatctttattgctttccagggagaagggaggaatccgaacatcaaagtgggagccatcaggtctttcaaagcggaacgtgcccctacagtcagaaagaagctggtttagaaggagccagggctgaggcctcctaaggatctggatggccccatgccctcagctgccagccacagaggacatgtgagcctgagctctcttctatctctagctcatgacaggatgactggtccagagacccaagagcccctcatggttatccatgaaaagaaaaacacagctgcagtggctcacgcctgaaatcccagcattttgggaggctgatgccagcagatcacctgaggtcacctgaggtggggagtttgagaccagcctgaccaacatggagaaaccccgtctccactaaaaatacaaaattagccgggcgtggtggcgcatgcctgtaatcccagctactcgggaggctgaggcaagagaatggcttgaacctgggaggcggaggttgcagtgagccaagattgtgccattgcactccagcctgggcaataagtgaaactccatctcacaaaagaaaaaaggaaaacacagctgtccagattctggcctttagatacatactgcataagctagccaactgcattttcaggtaaaggagtgaaacaccaagggaaaaaacccaactatacaagcaattctgcagcatcaaatcaccagacctctttagcctaagtcctcagtccacaaatcacagggtactgggaaacaggcggtaatagaaaatcagacaagtcccacacaacaatatagcagataaggctccctctaagaatgtaacttggcccagagttaatggcaagctctaagctctcacttttctgacctacagcttctgtttgtggagctgggtggcccctactgctgtgcacactcactcaccacatgtgcccactggaagcctgcagcgagacgtggctgctatactggaacgcaggctgctccttggataacactggttcctgtaaaggtttaggcaaaatgggtcaggccaagccccagggacatgtttcctgcaccccagggttacatgctgactgccagttcatcaagactggatgtcccctacccagccaccaccacagcaggcactcccatagcatgatacacttcctgccagtacctcctcccatagatggccatttggctgggccttttatgctggctctgggaaagataatctcagactgaatgtccgaaggcactgggcaaaggacctcctctgcagcccggggaacacagtgagaccccatctccacaaaaaaaaaaaaaaaaaaaaaaaaaatttaaactaaccaggcatagtggtgtgtgcctgtagtcctgctactcagaaagctgaggcggaggattgcttgagcccagaaaagtaaactatggtcgcaccactgcactccagcctgggtgacacagcgagaccctgtctctaaaaacaaaggacctcctgtggagatatcccctccagtgtccattcacacatgctggcggggaccacggcaggtactctgcaaacctctgctgctttaattctcctaatgatcataagataactggtgtgatccacattttaggagtaaggaactaagattttggttaaataacttgccgaaagttatgctaatatataactcagctggaatttgaagtgactacctaaatccaaagccttgttcttattcacttgcccaactgcctccccagtcctcgctgactttgataaatgcttgttgaatgtggcccctgacaccagtactgcttgtgactttatttctcaggagacagggttgggtaggcagggattataaaatcagatctcttcaaggaccagcagaggatgtaaacatgtaaaggggcaaagaggcaagaccacagggattggtgggggtgtgtgccccacctaacgacattcaaattttagtttttaaaagacactataccagttttaaaaactacacaagttttgacttcagactcacttgggtttaaattgaggccctgccactactagctatgggaccatgggctggttatttaacttctcagtctcactcttttcatctatgaaatgggtttcaagaaacatatctcatgtagttgttttaagatttctaacccaaaacaacacaatgtattcacaaagtgagcctctgtctataacaacaaaggagaaggaagccatgcgctaagcccccaggcttgccacacaggaccagaattactagaccaaggatgctcaccctgcccactacccctcggcctcgcactgtctccaaggtgccagagagactgaatatcctccagtgccgctcccggagctgtaccacatcactgtcaaggttctccaaacggatacagtagcgccactgaggtgggtgtgggagagagagtttaaaaaaaataaaatttgggtaaccctcctcagaattctgtgcaaagcaaaagtcaacaaagctgacacatgcactgcacaggttccgctctcgtcagaaggtgggctcccccacctccaccctgacccccaggcacaccccacaagctccccttctcccagacagtgacactcacccagtacacgtgggaattctgggcttcctagggagaaaacaaaaagaatttaagtcccacagggcaagaccaagtgtgttccaatcaacatctctccagtgcagttgatgtattccaggaaggttgcagacagaccaagctgagagtatctgtgggataagggtgatagctgaaccatggcctacacacccacagggaggcaacatccctgtatccactcctggcctccccactcctcatcccttcaagatcaccaacagagctggatgccaacagaaatcagttacagggctcttacctttttcactgccctcctcaccagccctgccccctatccttgctgccctgagcccctgtcctcctcctgtctcccattactgtcccttgctataatactttaagttggcctcctccactactataaggtcctggaagacagggacggtgtttcatttatatttgtatccaagcatgcactgactatacgtacttttctgacctatagcttctgtctgtggagttgggcggcccctaccactgcacatgcttacagccaggcgatgtgtaagtgtctataatgtgtaaaaagtgttatgcctacactgctttaaataattatgtgtatattcttcataaacatggctccctttgagcaagagggaagagacaggataaaggattccttcctgggacctatgagttttcctgcccgctctaggtcttggtgtcagccactgtctagaggctactcaaccccacccaacacatgccaccacttggaagcagaaccacagggacatggtttatatttagactcccttcccccggcagtcaccttaaggacaccatacaccttggggcctacccctgctagaaggggtccaggctggccacataccctcatgcccatgtagaaggggatgacagtgacacgtatgttctcagttgtttcccgatgaacatcggagagctccagccaggggtgattcttctcttgccaggcccttagcgtctcccgagccacaaaaggaggtgctggggcaagatacaattggttagtccaattgtgtgttgtggatacaattgtatctagtccaatcacacaatagtccagtgcgattgcccctcctagaaaaccctccctagtggtggcccaggcaaacaaggtgctcatacatgaagcaaaagttcaggctggaagaaggcacaggactgctaccaagaataagccctgaggagctagtgtgatacaatgggaaaacaatcggactggcagttaagagccctggttttcagccctcactctgctactagcaaccttgagtcccttgtcatcatccctgatcctcagtttccatatctgtaaggaaataactgccatctgtcatctgtcaggtatgacacctatgaggcatgacagctctaacaggaggttgaaaagggttgtggaaatagagcgttggaattatttcttttttttttttttttttggagacggagtcttgatctgttgccgggatggagtgcggtggcatgatctcagctcactacaacctgtgcctcccgggttcaagcaattcttcagcctcagcctcccaagtagctgagactacaggtgcacgccaccacacccagctaatttttatatttttagtagaaacagggtttcaccacattggccacgatggtcttgatctcttgacctagtgatctgcccgtgtcagcctcccaaagtgctggagttataggcgtgagccacaagcacccgggcctttttttttttttttcctgagatggagtctcgctctgttgcccaggctggaatgcaatggtgcaatctcggctcactgcaacctccaccctcctgggttcaagtgattctcctgcctcagcctcccaggtagctgggattacaggcgcccaccaccacgcccagctaatttttgtatttttagtagagacagggtttcaccaggttggccaggccagtcttgaactcctgacctcagatgatccacctgcctgggcctcccaaagtgctgggattacaggcgtgagccaccgtgcccggccctggaattatttctatgatattctttgatgaaaaggccctcccattccacctccccttcttgagagagattaccttttgtctggtcatacagaagaaatctttcaaagagttcatgttggatgggaacctgatcagtggaggtgtaggggaggatgtcttcatggctgacatagtccaagcctggcacagagatgcaaaagacagtggtgaaactcacaggagaggagagagatggggttgagaagaaacattaactggccttgttccagtatgggataaccctgatatcatacctctcagcatcataatccctcccagtggatgacaggacatcagaatcctctccctgagacacaccagactccttcttgacgggcaccattcaaatgctaactactcacctgggatggcatagagggcccgactgtcatcatggttagccaagaaggtcacagcttctgtctgagatctctgagactaaggcaagaagtgaatcagtggtgaaaccatgtctctgctaaaaagtacaaaaattaggctggtgtggtggcagatgcctgtaatcccagctactcgggtggctgaggcaggagaatcacttgaacccgggaggcagaggttgcagtgagctgagatctcaccactgcactccagcctggcgacagagtgagactccatatcaaaaaaaaaaaaaaagacgtgaatcagggctttgttggccactgtgcagtccaaggccttggggaccaagactgacctgggctctgtttgacccccttccctccctttgtccccattgggatgcaggactttccatggagaggacccccaagcccagccatcttgcttacttactatatgtgggcagtcacgagcatcaatcagcacctgatagtaagtgtgagttttgcctttcacctccttggagccatggccagcagggttctctgctctatggggtgggagaaggaggccaagatcaccccaggagaaatggaagctgtggctgactcagctccctactcctcctcacctaaacaggctggtctctgatctaaaggggctttagcaccagctggacacctgctctgcagcacctcagctcagctgctcctcagttggggcaaataatagagcatggaagaccatggtatggagccatcatctgaccgtgtggatacctcttaaaagaagggggccatgttgagaaaatcaaattgccacctcagtccccagggcccagagtactcttgtcttcttatatcccagggactgtctgtgatcacttaatggggctgaaccttttctgttttaatgtattctagggatgatgtgagattgagggaaagactccagctgaacatcaagaaatcaagaagacttgtcccccaaatgccctctgggatactcataatgaaaattaggaatggcttaggaaagcattctgaggaggcctaaagggactctctgacttagactatccctggcactcagcacttttgtctccatgggtcttagtcccagagaagtactctggggatgtttccaaggcctaggaggacgctgtcttcacccctagtaccccaattacatatgtctgccatctcctcctgaggatactgtgaggcacaaccacagggaaacttacttttctggagctgcagaagccacatcccggtcatacagtctggcctgccagggaaacaggacgacacctcggtagccaaaaatgctatgaaggaaaagctggaaggaaagaggggcctcagtgagtctgcagtccagcaaatccatccaggtgggccccagaccacaaagcaacacaggtggaggcaactccagcacaaggtcttgctacctcttcccttgaagtctgtgatcaaccagaccaatgctggaacactcttatttcttctttacctggctgactctactcatcctttaggtaaaagcttaggcctccaggaagccttccctgacctcccttccacttagcacaatgtacagctattggccatttgcaaatcgttcttttctagactagaaactccacaatagcaggaatcatgtctactttgctttctgatttaaccctaatgcacaatgcctagtccattgtaggcacacagaaaaataaaatgttgaacaaacaaaaagtcttccttacctacaatatcctagaagggcctaaatctatcccagtggacccagaacaaagctgatatagaaaaagaaccacacatccagagtttaccacactgaagtcaattttattacggcaaagcatcaaaggtatacttttctgaaagctccctccacggcttcccaccatccactatgttagagaaatcttcagcaacttggctaaacctcactatagtccacaccatccctgtccacattaacttggaaagagaacccactgacacattaagtgcattcaaatccaggagaacagaaaccctatctataaaaatttgattctgggctgggtgcggtggctcacgccagtaatcccaggactttgggaggccaaggcaggtggatcacctgaggtcgggagctcgagaccagcctgaccaacatggagaaaccgcatctccactaaaagtacaaaattagccaagtgtggtggcgcatgcttgtaatcccagctactagggaggctgaggtaggagaactgcttaaacccaggaggtggagcttgcagtgagccgagaccatgccattgcactccagcctgggcaacaagactgaaactccgtctcacaaaaaataaataaataaaataaataaataaaataaaaaatgaatacaaatttgattctggaatggcaccaaacatcaaggtggaatgaatggaacaccataccatgcaggcctgtgacctaatctgacttttttcagaagcagagcactctatgaaaatgaaagatgacccagcccaatactcacctgcccggtctcatattttccattctgttttggcacctcaaacacaccaactgtctccaacactttgccctctggtcggtttctgagtaggaaggaaaagaacaagcaacagaaaagctgagaaggtaatggtagttatccataagaaaaagctcctaggatactgaggggccagggcgatgacagcagagaagggtttggggtagtgggaccagctggagcaggaaaggctttcctcctccttggtgaaaacctccacagtctcccagtgttagatgtgaccgctcccatactactgtcttctctcttcactgggcattcttcatatcatgccctcacactctgctcaaatgtacccctgcccttgtttcttccctaacccaccctcctgacctcccacagcactttaactgtcttgctcactttttcaatttttttagaaggggagtatctttttttcttcttttcttacattttctatatcacaagtcatcaaacaatatcctgctccctttacatttcagttgtgtccatgtcttatctttattaaatactgtaaattccctgggagcaatgcctgagtctgattagctggtactgccccctcagagcctagtgtacaagaggtgctcaaaaaatatttgtcctgtattataattccatgtccatctccccctctaacctgtagcccttacattgcccttgaaaagcttaaacatctctagatttcctacggcacatcgctctctcaataccgtttttgttcatattctcacaggggtcttaaattgcaaatagctatcatctctccccaatgttcagtgtctaatatcagccactaaaatgtcagtcaccactctgaacagggctgctctttctaggggcccttcaaataaaggctgtttttactgttttgaagatgtgaactttatgcttcctcccactgatccaccagcccatttgatccgcctgtcccatccgtggaaacagtttccacaccatccccatggcctcaaacccccttccccaagtcacagatagaaaatcgatctccccaaagtcacttggaaacctggggcctacgagggtccacacccaagagtctcgtttcccacctctagcatctttctgaggcagaccttcaccaaatccaaaggctgagggttcaagccaatgccctagggctgaattaaaaagcttccctctgacatcggtgctggggaccccagccggggaagtaggattcacttggggagggtaacctgttcccccccagggccagccctgtacaaccagggctctgggccgcgctggcttccctgctcctggcacatgtcccagacagcgcaggtcggctccctgctcgggaccctctcccgggtcaaactccagtcaccctcagcaggcccgggcccctggcctccgcactggctaggaacacgctctctgggctccaggcccagttcctcgcgccccctggctccgtccctcaccgggacgagaggtgcctccgcgtcgtcgtggtcgacgctggcgagaaggctccagctccggccgccgcacagagcggctttgccaccgggccccagtcagcgaccgggaccaccagcggctgcccacggccaggggccgccgggctgtacaggctgccatgtcccgcccgagcgcccgcccggctgctgacacagagcccgacccgcggccgggcggttccgccccagtcccacactgccccgcgcggcgtcccggccctcttggcccgcctggtcccaccc

SEQ ID NO: 14981 - DNA, 1094 bp, Homo sapiens
ctgcctgggcgacagaccctgtctccaaaaaaaaaaaaaaaggaaaattcagcttcctcggctcaagggcctatctaggcctggtgagaaggtgaagaagagtggtcactggcctagagcacacatgagtttttgtcccttggctttgctgcaagtctttttggaaagagacaagcatggcccagcccagaagttctagaagtccttggcctcatcttgcctcaagggcattgcttagagatttccagaatgtcattacttaatggaaaatttatagggtctgcttccttttgggacagcttggctctgcaccctggccgcctgtgtccttgtggctgggctgctcctgcccctgcctgccatcacttacctggcgtgtgcttggtgcgcagcatcagctatatgtttctggagctgctttctaggagaaatctaatcatagaaaccaaactgaatggcattccttggcctcactctttgtaccctccatcttgggatccaggcttccacagtgcctttaggcctcccctccccttgaccccatcacacttgtccccattggtcactttggacttgctggtcctgctgcatggaagccctctccagcctactccacatgtgagtggggtttaaaccccactgacttgtttccttgtctgtgatgctgtccttctaccaatacttgtgtccagtcacttggtgtgtcctgtaatctatctgtgtctggaccaagactggtacactggacccaaggttcccagcaagctgatatgtggcttgtgtcatttgtccctgtgtcttctcctatctcactggcctcctatctccacagcctagtccatggagttgctttatgtagcaaattctccgtttggagcttttaaaataggattatttgccagaactgcatttacaaaaaaagtttgtgtaatcctggtttaaataaattacacaaagtaattcactggcagctagggtgcctagtgtgtgctaggcataaagctgcttctgaacccactaaaagttcatcccagaatgatatctccactgagttcttaggtttattactagagatgaaaaaaaaaaaaaaaaaa

SEQ ID NO: 14982 - DNA, 1094 bp, Homo sapiens; identical to SEQ ID NO: 14981

SEQ ID NO: 14983 - DNA, 9716 bp, Homo sapiens
agagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgtgagtagtgtgggcagggcccagggtggccgtcctggaggtcgtctcctgcatgtctcctggtcagggcagttcctggggggagggtaggagatgcatttggaatcatggtgagagctgcagggcccttgagtgagtggtttcagcagttctgatcagttgaaatcagggagaaagaatgagctaattggcttaacaataactggtttcttagatattggaatcctggggaaaattgtgtagaggttgaagcagtgggagaaaggaaggcccacagatctacttccagttccatggtgagttgaagtcagagcacttggccatcctagccccttcatttctcaggtgtggacatagttgatcaaggataagtagacgtagttgatcaaactatgctagaggggaattggcttgctgcagtagtggtcacctagcatcatcgtcactgtcacccggagcacacggtggggaaagatagtgggattacctcgcagggagtgcaagtacatggaggcgtccccagttggagaaaggtggctgtggctgcagctgcacaggtggtgttgccctccctccctctggctacagcacacttgctcttgtgcttttgtgagcccgcccctcttctctttccctggagagttttccatatgcccatgtccctagcaaactgttctgcaagcaaacctgtatctccagctgaacctcagggagcagatggaataaatgcttcagtttttttttctttaaagcaccaaagactaattgtctttaaattgtcctttgctgtttgccaagtcctgtacaccccctggcaagtgcattaggtggttgcagccactgacccagactggtgtgtgcacaccagagccactggtgtgtgcacaccagagccactggtgtgtaggagcggccttagcctctgccaggcatccttactcccaagtttaaagtcattgtgtctgtaagaactgtctggtgctattgcttcactgaatacgtgtcaagcactcgggggaagataatcagaacagggcagtacgtgtctgggtcttgaaatggctcaggaaaggtatggaggcagaagaggcgccacgctctccattgaccaagatgaggagtggaggcagtcagctgtgttggcctgcgggagggagactgttgggggagctcactgcaccaatctctagctgggctggacagggtccatagttgagagtgaaattctcagagcagatgcacagaaccaggagagaaggaactggggactggagtggaacccagagcgttgtgaggcccttaggggttggagggaaggcagaaggcctacagaagagagcatttccccagattccaacatcagaagctacagggaggtcaaagagatgaggattccgacctgatcatcctgttgacctttaggagggcattggtgaccttaggaagacgtgacacagaagtagaaaccagattgcgacggtgtgaatgagaaggtgaggatgtgaagccaccatttcaagaagcttggctttgaagggaaacgcatcagtgccagaatagcagaggggtcagcttgttacaagaaaacgcagtgggaactgaagcagggagggctgagaaggtgaagacaggagaaggaagggctgggggacttgagattgccgagaagcagcagcatcccagttgaggttgagggaacagtgctggccagcgggacagacaagtatgggtgattggttaggccatggggtttgggagttcaaggtcagtctctgaagtgcaggctggagagtggccaggacgttcttggtccaggcagagtgtgaatctacctgtccctatgactgttgacgtcgccctcattagctctgacataagaagaagggactgatccatggtggccctgatctgatgtcttcagagatgggagagtgaggagctgaggaaggagcttgctgagtgagagtggtctcagggcatttggtgggggctgagccaaaggggatgcttgatcaggagcatcatcatgctaaatctgtattctggggacttccttcttcaggagatgttaataaggccaccctaaaaagtattccttgtctgttttctgatgccttctaggtcttcacccgcattttgatctcctatcatggccccaaaccgtactatccaggctggcagttcctcttcccccaccgttctctctgccttcaccccaattcctcttcactattctgttggccattgagacatgtgacacactgtggccaattcagtggcctttggccatagaataaaatttaaatttccactgggatagatctattcagacttggttctcttgggaaaggaggtcagagcatagaaagtggcaccgatagtctgcttccagtctcccctcttgaccacttgcctaaggtgcctgggtgtgcacttgtagccctcacccccagggcagttccatgagctgtgccaaaaccttacatgtaagcaggtggcccttgactctttctcgtggatgtcagaacatctcaaaaaccccacacccataccctgtgctggcctttccaacgctgtccactaccatcccgagcagggcctcagtgcttgctgttagtatacctgctctcttctccctgcaacagcctctccacctgcagcctgtgcctctaccgtgggactccacttggatttggttctgatacaccacttgaacttaattacaggagcacctgtcctcagtcagagtgatgactcagaaagtttggctatcggtgggtcaggccaacagcctgagctggtctagtcattggggacttgctgtctgggtgcagccccctgcctggccctctgtgatcctcacacctggaaacccaggcactgcttgatctgtccgcacattccttctgtggttgtttttaaaaatgaacttagttttagaataggtttagatttagagaagaagttgtgagaataacgtggtttgatttcgggcactttaagacgtttacatctgttatctggctccttctgtttggcacttagtaagatctgaaagtttgagggttgggatggtggattttttatttttatttttttaaactaaggattgtgaaggctgtccagatttgtcatttggcagttaacctggtcagtcagcagtatctggatactaaagaatccttagtggtagactgtgtgcaaatgaaagaaacgttaagtccagtgaatttgactaggggtggaaacttatgctccgcagctcttcatggtgacaaggaggcaggagtgccagggtcaagggttacaagtggactccagcattggcgccaggggaatttgcattttatggacatgtaaaatttcaaatgggacaagtaggacctgccatgggttgtcttactaggtgaggattgctttttaaaaggctgcctggtttcccccttatttattaaaagtgaaagaatattttagtatccataaaaagaaaaaatgtgcatttcaatgaaggcagcctatttcaagatagagtggttggaaacttgtacgtttccctctgaattactccccagcatccaggaacccttccccgctccactttattttggtgttccccctcaagatcacttgctgatgccagtaggagctgtggctcccgtggatttacctgtggagcagccaggggtgaggtccccaggccagcctggccagcccagcgtttgtgctgcctggctgcctaggtgacactggacttttgctctctgctctccaggattactataagatcattaaaacgcctatggatatgggaacaataaagaagcgcttggaaaacaactattactggaatgctcaggaatgtatccaggacttcaacactatgtttacaaattgttacatctacaacaaggtgagatgtaggggtgggtgtccagctgccctggggagagaggaggggaggcgacggcagtgggcatgtcaggagcccgtgggcaggggtgttgggtgtggctgggcttggagtctggcaagaggagacccttggaggtagaggtaatgagacctgtggttgttcctgtgactgggtgtgggcttttttgctgggaggagggtgctggccatgttgaacttgcaagctgtccttgttagcctgaagcatgtgcttctggtgcccttgggattttggttcctgagcatgtctagtagagaaggtgtgaggagaatagtggcgactcatgacaaagtccatttgggtgatgtaaattgttaggaaagagcctgctaaaatgtagttgtgcagaggtgtgcccaaacagagacctccacgtgagagagggtgtgatggggccggcgcagagctcagttgctctgtgggtgatggtctgctggaactgtggacatgactgtcaataactcttggccatagatgaagtgtccccccgatcctacatgtagacctgaaggtcacttcctaaccccgtagccaaacctttcggctcggctgtgccatgaagccagatcatttgtttacagttcagaccacagatgtgattaaaatcaaccctttcaaatagaacgactctggagggagacactatacagaactcagcttttgacctctgctggtgtagtgggtaaaaatgcccagaagagatgggtaggtgagtttcttgaagtttactgtgttttttaaagtctcagctctcaccacttaggtttgagcaaaatgtgcagaccaggctctcagtttagaactgagtgggaacagcatgttatagatgaggtgacagagtgggacccctcaactagtgtgagatgtgcagtgcccagagtcctggtgagctgccatgggggtacgttggggagcattgctggggccctgctaatgtatcatggcaagaaatcctgtgtcattcacgtatttctggtgaaattgaattgtgtcaaaggagggcccctttcagtgattggctgagcttggtagatgcttaaggcattaggatggcttctcagataggccagagcttaaaagatgagggaggtgcaggtagacaagtgtaggctcagcacacctgtgggaacacaagcctctgtgatacctggtagtgtagccattgtggctcctttgggtgcagatcggggaaggacccggaatacgacgcttcatgttttgggggcagggggtgggtggcatggggtgccctgtctacagaggtggggaggggagggccctctgactctacccctgtgtctccttatccagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacaggtagagtactgaaatagcaagtaaattggctttctccccgacctttgtcccttttccaagtttggtggggggctgggagtggcaggaggatgtgacattatatactgcatgccgtgttggtgtttggacatgtgagattgggtttggtgttggatccatcccatagggtcatgtggccctgtggcctcttctaagcagaaataattgggccctgccttttctgagggtaggtgatggacttagggtaaaaggaaagtgtaacttctcaaagcactttgacgtttgttgaacacttcaccctgccagtatcataggtggtttttacttttccattttaaggacattaacatgaccagaaatcattttaactaacatctcagttctaaactttgaggtttgtgattggaattaccttaatgcactggtgtcagagttatccctgcttctgatgctcagtcatctgaagtgaaagccctcctcatccatctctgcctgtcaccacccccaactgacacagggttccaggggccagctggcagagctgcccactctaggaaatgattctgtctaggaaactctccagcagctactggctacatcttgtcctttgcaactccatgctgcagaagggtgacatttgcgaggtggtccctgagtgtgagttgtttgcttctctgagcagcagcctttcacctggcctcccatgctgttctgaagtggtggcagaaagggggttgctacatcccctgctgcacccaaaggtaaccaaggagaactagtctcacgtgtcaccctgtggctcttgtacctatcagatcacattcctgatcctcatgtaagtcacatcccttatccttacatgaggatattggtcctcactccctgggaccaggggtttgggctgcacgctgggcagacagacgtggtggcatctcctattccagtctgggagaagcccaggagttgtgcctgaggaaggagaattgggaaactcagcagaatctcacccttgctccttgagatgcacagggaacatgggtgctgcttgagctgatagatgaaggcactgggtgtctttgtccattttcatggcagccagcatgcacacgaaggatgtggtgacccaggttatgctcctagacattctcaccctggtccacccagttttgttagagctctggccataacccctcactttttgcagctggttgggtgtgccacgtgaccattgtgtgttcggactgcctgcacagctgctgggaggcagcgctcgagccagtcatgaagggcagcagtccagctgccccctgtggttccaggaggtgggggcctgccagtttccagaaaccttggcaagggcggctactgccggctccctgccagaagctcttactcagaaggcagtgcttctgggaacaagggcagctgtgcctggaagctctgaggagtgttttcccgctctctgtcccctgtcagcatgtgcttcctgctccttgagcctgggcctccaggcttcatgaaggggtctttgtgcctgagttgggagttgcagccaggacgccctaggaaatgggaagtgcggttttctgctgttctttgagccccagggacaggtggaagggtttggcagagtggagtctgggatgttcgtctctcaggcaaatgcaacacgcgaatgtgcgttcactgtgtgtggtgtatgtccccacgaggtcagccagcatgtggatgtcagcatggtctctaactcgccgtcttattatgatttgtagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaaggtgagtctcctggactctggagggctgcttcaccagggaggagagcggccctgtccttgcccgtgctttacacagagcctgtcctgggtcccgggcactggtgggtgtttctggggagatcttgctgtgttgaaattgcagcccagaaacagccgccccactgactcaaaggtcccataattgtgtcacacctcctagtgggttcctgccccctgcacctcttttatttagactgtgcatatttgcagatgggccatctaaatagtctctgaattgtgcctcccctgggcacttggggagaggccctggtgttaggtactaagcagcctccagaggtcccttggcttccaagtgagcacacagttttatgctttctcctgccacaggcaggtcctgtcccagctgcagagcagagtggtgggacacgatctgcctgtccttggccctttgcctgtgcaattatctttgggtccattctgtgtgagcgatgggccccaagacagggcctggctttgggggtgaccctgagggcagctgtgccggctgccacttctgactgtgcctgttggcgtccgtgttcttggcagacaaagaagggagtgaagaggaaagcagacaccaccacccccaccaccattgaccccattcacgagccaccctcgctgcccccggagcccaagaccaccaagctgggccagcggcgggagagcagccggcctgtgaaacctccaaagaaggacgtgcccgactctcagcagcacccagcaccagagaagagcagcaaggtctcggagcagctcaagtgctgcagcggcatcctcaaggagatgtttgccaagaagcacgccgcctacgcctggcccttctacaagcctgtggacgtggaggcactgggcctacacgactactgtgacatcatcaagcaccccatggacatgagcacaatcaaggttagcgggatgtgcctgagggaagggacaaggtgggcaggctgtccctccacatcagaaccttcctagaccttttagtccaagaggaagcccaggccctggaacggtggctgcgtggatttttcccgccaactcgaagaaactcagcgccccctgctgtctgctgtgggacgtgctctgagacctggtgcttggccattgtggctacagatgcctgtgctgccccttcccctagtctgaggaaaagcaagacaagccctctggccttgggggcccagtgccccaggtaccttgcccacacagtagatgctccatgggagttggggcttggcggccttgccagcctctttgtggtggagaaggccttgctgtctcctctgtgttggaggcacgctgtaagtgccgacattttcaccatagtgttttgaggcttttttagttttaagacttgttacgtgtttcttcttctgggagtggagtcccaagcatggggcaggcagagcagggaacagtgctgtgtccctttgaccagctcctgtactgtgtcatcacgatgagctgggcccagccctctccatcagttctccccgtcatttctggctcaggctccgcctcctgtgggttctgagtccacctgcctgcgagccaggcaggtgagctgggatgttggcagggccagtcccagccctgaggctgagaactggggtgatggcctgtccccccactagagtcttgaccaaactgagagccaagaaaccaacttgctcttctaggcatccctttcgtctgctgccagccacttctccatggtcacatgggcagacacagctaacagggacttgtcttgttttccagtctaaactggaggcccgtgagtaccgtgatgctcaggagtttggtgctgacgtccgattgatgttctccaactgctataagtacaaccctcctgaccatgaggtggtggccatggcccgcaagctccag

SEQ ID NO: 14984 - DNA, 269 bp, Homo sapiens
tgggtctcacataggacttctcactgtacctctctttcttgccccataacagactagaagtggttggttttcctcatgtttcttgtcattgcagtaagagtgggctcttgaagtttcccaagggtcttactttcctgtagtcatgggaaggctgtgggcatagcagtaggtcagtgtggtcccttgaggtgcaggtgctgcacaggcccagagtgggtgcaggagtcccaggtatcttatggtgatctcccttgtggggccatggatat

SEQ ID NO: 14985 - DNA, 269 bp, Homo sapiens; identical to SEQ ID NO: 14984

SEQ ID NO: 14986 - DNA, 532 bp, Homo sapiens
ttccatatgcccatgtccctagcaaactgttctgcaagcaaacctgtatctccagctgaacctcagggagcagatggaataaatgcttcagtttttttttctttaaagcaccaaagactaattgtctttaaattgtcctttgctgtttgccaagtcctgtacaccccctggcaagtgcattaggtggttgcagccactgacccagactggtgtgtgcacaccagagccactggtgtgtgcacaccagagccactggtgtgtaggagcggccttagcctctgccaggcatccttactcccaagtttaaagtcattgtgtctgtaagaactgtctggtgctattgcttcactgaatacgtgtcaagcactcgggggaagataatcagaacagggcagtacgtgtctgggtcttgaaatggctcaggaaaggtatggaggcagaagaggcgccacgctctccattgaccaagatgaggagtggaggcagtcagctgtgttggcctgcgggagggagactgttgggggagctcact

SEQ ID NO: 14987 - DNA, 14333 bp, Homo sapiens
  misc_feature (4792)..(4792): n equals a,t,g, or c
agcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggtaaggaggataccagtgcaggaaatagaagagctaactgctaatgtggccatgggccatggcgaatcctggtctgtcctgggcagcaccaaagctctttccccttcttagaggctgcgtgtgcagctcggggagaggggggttttctcactcctgtgggatggtggcatcccacagccaagtttactctcaggatccatgctaggcactgcccttcgtgggatcctatttagacaccacagagatcactccaggcagtggaaaacagccccccactttttatatagagaggagattgtggaagctcataaataataagtagggatgctgggagattattgagctggtatatttctctcgaatagtggtgtgttcattgttgctattgttggaattagaggtgatactaaaaaaggaacggaaaaataccatggcaaacacataaaacgtctctacaggtgcctacctaccactgggtcccagaaagacttgctgattgtggattagatgtggtcccctgccctcgggagttccccagacatcaaaatgagctccctcagcagaagctctcattagctgggtgcagggagaatctagcaatgcggtaactcaggccttcaggacttttgagttagttacttaaatggaagtcctgagacaggtcaacacactgaaccctttggatgttttaggaatatttgttcctttgcaatttggcctttttttccccagtcatgttcaggttatccttggctgcaggtagtgaagaggtgtaccactctttaatgtttgtactgagtggcatgttcacaaaaaagctcagaattcagttgcattggcttttcaagagggatttgcagcaagggctggtttccaatatggtagtggaggaattggctaacataaaactagctcctgaaattcagacttgcgtttactgctctggctctatggaattagtaaccatgggaaagaggcaatgcttagaattgtgtaaagtgatggagtaggtagagacctgtcttgaagcatcggtaacagtaaatgaagcagcagcaagatcaggtgttctgtgccacattctttttccattcatgtttcatacaacattgtcttcaggaacatggttcagtgttctcccaacccacaagagacaagcaaaataaaaatggactaaataatttgctagtttttaattgggctctttggcacagactcaagtagacctgaactctcagctctgttgtgaacccgctttgtgaacaaggacaaagcatgtcatctgtctctgagcctcagtctccctgttagtcagttacagagagagcgctccaagtttccttccaaagctgtgcactggctcgtttctccatcagctttggttttccagttggtctccagctcatctttgcctcacaagagcgtgccctgctagttgctggtgctgggagtgggtgggaaggtgattgggcgccagccccttccttcccaggcttcacacacacaccccaggaagccccgcagtgcgtcggactctctgtctagacatcatctgatttttatttgcaaatgcaggttgccaggtgacaggaaccttttatgcttgtgccccacctgagtcccaggctcccggagtccccacagagccaagcataaggtctgccgaagccttggcgttctcaggtgagtgcagggtttgctcctggaggcaccgcaggaggccagcctctgctgccagctctgtcatctttgggcagattcgatgggactttagacacttgctttgctccctctggggtctggagtagatgtagacacatcctgtgtgtgaggtgaccagggtgatttaggagcaccattagaaaacctgacatcactgcttgtggttctgctgaccgtttcagccactggcttgaatggagtcattttggcttcttcactggcacctctctgaatttctaggaatgtgcctttacctttaccgagggcccctcttcagccaacattctcacgatgtggaataattgcttggaagtgtagaagggcttctcattttgagaagctgatcatccttccaggttgagccacaaataagtcctcctcctctactccctggggacattagttctggtccctcatctctaaaacattgatgtgcctaagagtaatacacattttggtcttcctctgaactttaatatagcttgcaaacaaatatggattcaatctgatttttaaagttttatttctaaaaaaaaaaaaaaaaatccctgcaccatggagatcttacctactataaagaaggcacctctaggcttggcaagcacacgtgctatatgtatatttatttttcagataatattttggattgtttttaaatgggatttgtttttatattaaaaccaaatagcttaaggtttggaattctcatcttgccctctggcatctttaaaaatcagtgatgaaaaatactaactaaattctgaaggtttcagggaggcgagagttgtggcacttttgctgctcagaggggagctggagtttgacctaccagctctttctagttgtgaatgaggcttgcacctttttttctgaggtgctcgtgagtaactgaggatgccctttgggaggaggtgcttctgagcaggaaggcttgtgtttgtttttagaaactttcaaacccttgtcttgaacacctaagacttgtgtgggtgcctgaagagtaggaaataaacagctatttatatctcggcaacctcgtgatttctgatgacattaaatgaaatgaaacctgccccgagaatcacctcgaatggccaacacccactctctttggggcgcactgtctgactcgctttcagacagtgtgttgaagcagagaattgagacagtgatgtgggttaagtctcaaaacctgctgttgaggaataagatagttttgtgggtttctttttttggtatgcatgatacagattaattatcagccatgagcacatttattagataactgtgattcccattgattttggggttccatacagttaccagtggcagctgcctcctgtctgtgccactcccctgcggtctggctgaggagcttgtgcaaacccagcttggttctttcaactcatgggcgatattttaaagaggcttctgaaatcagcaaaacgtttgtaaatggattcatcttgtttaaagtttcagagagcgcagttttagagttcttttcaaacttaaacacaaagcccagtgggaatttcagcagactttacatgaacttttagagtatttttctcattaatttctttcttttcacaagaattaattttgtgataaaaacaccacatatccagtgtggaaaactaatttaaaaatcagaaaaacaaaaatggaaaataaaaacatcacattctaccacccagaaatcaccattaaggcctcagtgcttaccctttaatgtgtgtatgtgagtgtgtttatatataaattatatagacataaataattaagcacctaattctatatataatttatatatgtacacacacacacacacacacacacatttgctttttacctaaatgatgtcatgttattattttggggacgtttcaggtatgtggaccgacttgcttctttctgaaacaccgttatattttttgctagtataaattaaacttagggttcatttcctccaaagtaaaaattgatttgcttaaagatgaattttcattcagtgacacatgacttaaatgacatcaccactatcatcatcataattcacaaataagacttagcaagttcttaatagtgatgctctataataggaattcaacttacatttccagaaaattaatgaaagatacacttgttccttaaaaaaagagtcggtggccacatacgtttgtaatatgctggtttagacagattaaatgggtttctttccacgggacttctccaagtgttgaccgagctcatgctgtctgtggatctctgggggagacaagggcacgctgtgtttcccaggcctccttgacgcgggaaccttttgttcccccacgggacatgtgggacactagagttccaccacaggtgcttggctctgtggagtcgttggcctcgaggtggtgtccttggcccccagcactgactccggagctctgtgtttgcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggccccgacgggctctatgcgaaaagactgtgccagagcaggatctactgggacgggcccctggcgctgtgcaacgaccggcccaacaaactggagagagaccagacctgcaagctctttgacacacagcagttcttgtcaggtaaggcacctcgttatctgttagaatggaggtggtgatggcctgcctgccacaggggtcagaaaccacagggtccctcccaccccaggctgaggtcttcctcctgttgacttcggcgcncactgggcttggggcttgactccagtagagatcttctgtctggctctgttgtgggcagagagtccggatcagatggtccaggtggaccatggctcaggctgttctcttgcaattctggttttcagcagtcgcctcttaaaacagttccatttcattgcactatgatctcgacaaatacgtctgctgatgtggcggctcttttcaggttcccagaaaaatcataaaggttggaagcatattgttaacattcttggttgtcaggtgtgtcaccctcatgcagatgctggcccacgagtgagacggagggtggagtggactgtactggttttgcacaggagaagttataggagagtgctataagttggctctgtgatatgaacatttctaagcatatttttcagaaccagtgagttttgtttttctaccttggatttcatgacaattcagcgaacctctggctggcttctgtgaagccctcgccctgtcatgctgggcttcctcactggctttgtggggctgtccaggtggagggagcctcccgcgtgggagggagctgctctacccgccactcgccaccccaccgccaactcttcctctgccttttcccagtcctgtcccttcctgagccccttcagaaactcctgtgtctttgatttctcatgtgcctccccttttcttgaatgtgcttcttcattcaacttatttaaaataaaaatatgacacgtctgtgtgctctggcactgttgacatgtgctcgtacttctgggtgtaagtgacccaagtttttgtaagctcatccagattttcttttggtgcccaaagcaaatatgtccccagataactaagcttcaggccaggtgtggtggcccatgcctgtaatcccagcactttaggaggctgaggtgggcagatcacttgaggccaggagttcaagaccagcctggccaacatggcaaaaccccgtctctactaaagatacaaaaattagctgggcgtgatggtgggcgcctgtaatcccagctactcaggaggatgaggcacaagaatcgcttgaacctgtgggaggcggaggttgcagtgagctgagatcgcaccacggtgctgcagtttgcaggacagagcgagactccattgccccccgcaccacaaaaaaataactaagctcacacagaggctgaccataggaagagggagaactgtgctggttccccgaggcggcggcaagtgaggaagtcacctggggctggacacctctcattctaagggcagaaccatccccaagccctggccagggcggtcccatccttcttggggttgggcatggtgttcatgggggaccaaggaaattgaagggcaactggggggaccccccctcccctgtcagcatctcctgtgtctgccttgggatctggaagagctcacatgggccaggaaggctaaggccactgggcctggatttctgaagactctggaccttggtgccagtggattcagaagataccacaaggtgagggctttctaatgaaagtgtcacaaggaactggcactggcttttctgagtgcctcttgctgggcgtttttagggaggtagagcccccgtggtgactaagctggaaggtgcacattgagtcacaggtgcactgcgtgagagacagcacaggcagggggtggacgcctgtgagtgtcctggggctgtagacttgcgcgactagaacttactattaatctgtgagcaagagctggtcttggctttcattccttcctctgtaaccaagggctgtgctctttgcccactgcagcctctcacctcaaagtgttcactgaggttcaaggaggatgctgtgaacgtaaaaactgcagctgtgccaaccagcttctgcataattaaggattcccaccaaacactctcatgttatctagggttggagccatgctttctcagagaattgtgccaactcgccattctgattagcctgtgtaggtgtagtctcagatcacggcagtgtgaatgtattttacagattctgactaagtcatttgggtttgatttgaattctggaaaaaaaaaaaagcaggaagtcaaatagtcctgtaagttagctagaaacttctgttcagttgaagagaacagtggagatctttgatatcttcctattcaggtctgcacagcactagggacagcccccagggccggccgagggtgtgtatctgataaggacgcgtctgttctgcagaagctgtagcggctcctgtgtcaactcgtttcttttgcgggcgtgacattttattgtagctacaggcagaagatttgtcttgtgtacaggggagggagcatgggctaaagtcaggggatgggcacttgtctttccaacaatgttccagtccgttttgtatcttttgggtaggtgtggtggcttcaggatgtacatgtgtatatccacaagcgggaggccaggggggctgccccactcctgttctcaagtcaagttactgttccatccctggagacaggcaagaagtctactcagagttacacagttcaggcatagtgacagtgggactcagctgccgatggctggtgctcagtcaccacgttgacgttacatattttctgtggtgcctgagttacgtggatgtccgcagtagcacagatactggattatgtgggctctgtagtgaggggatgaggttttaaaatgatcctgggatgtcgaaacattctgattttttaaatgaaaacttgtccatggcataaattggtcttttgccattgcgtgactacgtttcttgttctttatctcccgacttcactgtggtctactaccttttgaatcttcgtgggtccaatgctgcaaagcagtgttctttagctgtcgactagttcctcttgaagaatcgagggagaccgagggccctggggggaaagcacccaaaggaatgcatacatgctattttgtatctgagatgttcacatcaagagccccactcagcggagtaagagtgctcattcctcttgcagtgttcagaatcacagtaagctcttgcttcctgtttaacctggtgtgttcggtgatgagggtttctgaacatggtctctttcttgtgggcttctacagagctgcaagcgtttgctcaccacggccgctccctgccaagattccaggtgactctatgctttggagaggagtttccagaccctcagaggcaaagaaagctcatcacagctcacgtgagtcctcagttacactcctaccatagtggcttcctgttctttgtaaaggccagagtttcatttagaaaagtcccaaatgaaaagtaaatgtcaaatgacctggaaaaataagcgtaacccttaaactagtgagggaggaagcatggtccaacgagcagcacagtctgaggactcacgtgctcctcccagacttgagatctgctcatcaaagaaccagggaggacagcctcaaaggagggtgcctctttccccatcttttttatttttcaggaaagttgtcgtatttccattttatagggattgaaaaagattgatggttaaagttgccctttaaaattctccaggttaagattgctgtaagaatgctatctagctagtggatcttcattcaatggaaaagcttttcccaaatgagaaactatccattccctggaggcattttgtaggtctctgcagctgtgtcctagcacctcttttatttctggaattttagaaattatttaattattgggcatatgatatttgaaagaggctgaatctttcaaggaattcaagcaaatcagaccctctcgtaatgttctctagcatagctcaagatgggttcaactgtggcaagtaacactaaaagggtagggttaggattagggttagagttttcttttttatgagaaaaggtttccatagataacatgaagcattaatttgccatgggaaacagaatcttgaacccttaagacttttgaatttgaaaacttcacattgctacatacttgcaagcattattaacgggcttgcatgctgagcaataccaggtaaaagttacaccccctaacatcaaagttctcatcatgttctagctctgatgctatttctcattgagaactgaaatgaaacatggtttaatcttgaacatacaaccccccttcttgattttaaaaacaaagaccagccaaccaaccagtatataatcccatagactcaggagttttctcatgagttctctccagtgattgacttaataattgatatgattgttgaaataataactgatacattgttaacaacaggaattgctaaatgactaaataaacttggcattgataagcagcatttaagaagttgatgatcggccgggcacagtggctcacgcctgtaatcccggcactttgggaggctgaggcgggcagatcatgtggtcaggagttcgagaccagcctgaccaacatggtgaaaccccctctctactaaaaatacaaaaattagccgggcgtggtggtgcgcacctgtaatcccagctactcgggaggctgaagcaagggagtcacttgaacccaggagtcagagcttgcagtgagccgagattgcaccactgcactccagcctgggtgacagagtgagactctgtctcaaaaaaaaaacaaaaaaagaagttgatgatcagctcagctatcacatcaatccagttttaaagttgacatggatgcaagtcactgtcctctaagtcagggaaagatggatccccagatgaccccctcatgctgaagacgaggctgcgtggtccataaaatgaataaacacacgtgtacacctatgagttccacttttaaaaattattaatttaattcatttcaggtacttaggagtttagcttaagtcgtcatatataaaatacagtctctaatatcatgattgatggagagcattcagcttgccttagatgctgtaaattcaggaaaagctgaacattaaggcgtttttgttttttggtgagtgtgatccacgctaataaccagacagtataaatttgaggccagttagcttctctttttccacaatagtagttttgttgttgtttaactttactttttatttcttttacctctggttgagaactatacagattacctagaaatcaaatcattcaggatgagctccttgtttctttcaaactgcagttgtggaaaaacaaaatcattggcctaaattaccctgcagattccctcagacttccttttaatttgatcactttacttgatttgatgcagttttagttaaatgtacattttaagtggcagtcgatttgaaagtaacatctttaacccagaattaagtcactttggctgtttttttacatgttgatctatggaaggactaaccaaaaaattgcttctttagatggctccaaatatgaaatgttttgatgtgttctaggatgtaactttgggctttacgttactgtctccttagaatctgagtgctgtttaatagtgagccagttgcaggatatctcagtaatgtctttttaaaatctcttattaaaggtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaaaatcagtgacatctgattggcagatgagcttatttcaaaaggaagggtggctttgcatttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccgccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgactgccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctcccgaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaatttgtta

SEQ ID NO: 14988 - DNA, 10835 bp, Homo sapiens
aggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggtaaggaggataccagtgcaggaaatagaagagctaactgctaatgtggccatgggccatggcgaatcctggtctgtcctgggcagcaccaaagctctttccccttcttagaggctgcgtgtgcagctcggggagaggggggttttctcactcctgtgggatggtggcatcccacagccaagtttactctcaggatccatgctaggcactgcccttcgtgggatcctatttagacaccacagagatcactccaggcagtggaaaacagccccccactttttatatagagaggagattgtggaagctcataaataataagtagggatgctgggagattattgagctggtatatttctctcgaatagtggtgtgttcattgttgctattgttggaattagaggtgatactaaaaaaggaacggaaaaataccatggcaaacacataaaacgtctctacaggtgcctacctaccactgggtcccagaaagacttgctgattgtggattagatgtggtcccctgccctcgggagttccccagacatcaaaatgagctccctcagcagaagctctcattagctgggtgcagggagaatctagcaatgcggtaactcaggccttcaggacttttgagttagttacttaaatggaagtcctgagacaggtcaacacactgaaccctttggatgttttaggaatatttgttcctttgcaatttggcctttttttccccagtcatgttcaggttatccttggctgcaggtagtgaagaggtgtaccactctttaatgtttgtactgagtggcatgttcacaaaaaagctcagaattcagttgcattggcttttcaagagggatttgcagcaagggctggtttccaatatggtagtggaggaattggctaacataaaactagctcctgaaattcagacttgcgtttactgctctggctctatggaattagtaaccatgggaaagaggcaatgcttagaattgtgtaaagtgatggagtaggtagagacctgtcttgaagcatcggtaacagtaaatgaagcagcagcaagatcaggtgttctgtgccacattctttttccattcatgtttcatacaacattgtcttcaggaacatggttcagtgttctcccaacccacaagagacaagcaaaataaaaatggactaaataatttgctagtttttaattgggctctttggcacagactcaagtagacctgaactctcagctctgttgtgaacccgctttgtgaacaaggacaaagcatgtcatctgtctctgagcctcagtctccctgttagtcagttacagagagagcgctccaagtttccttccaaagctgtgcactggctcgtttctccatcagctttggttttccagttggtctccagctcatctttgcctcacaagagcgtgccctgctagttgctggtgctgggagtgggtgggaaggtgattgggcgccagccccttccttcccaggcttcacacacacaccccaggaagccccgcagtgcgtcggactctctgtctagacatcatctgatttttatttgcaaatgcaggttgccaggtgacaggaaccttttatgcttgtgccccacctgagtcccaggctcccggagtccccacagagccaagcataaggtctgccgaagccttggcgttctcaggtgagtgcagggtttgctcctggaggcaccgcaggaggccagcctctgctgccagctctgtcatctttgggcagattcgatgggactttagacacttgctttgctccctctggggtctggagtagatgtagacacatcctgtgtgtgaggtgaccagggtgatttaggagcaccattagaaaacctgacatcactgcttgtggttctgctgaccgtttcagccactggcttgaatggagtcattttggcttcttcactggcacctctctgaatttctaggaatgtgcctttacctttaccgagggcccctcttcagccaacattctcacgatgtggaataattgcttggaagtgtagaagggcttctcattttgagaagctgatcatccttccaggttgagccacaaataagtcctcctcctctactccctggggacattagttctggtccctcatctctaaaacattgatgtgcctaagagtaatacacattttggtcttcctctgaactttaatatagcttgcaaacaaatatggattcaatctgatttttaaagttttatttctaaaaaaaaaaaaaaaaatccctgcaccatggagatcttacctactataaagaaggcacctctaggcttggcaagcacacgtgctatatgtatatttatttttcagataatattttggattgtttttaaatgggatttgtttttatattaaaaccaaatagcttaaggtttggaattctcatcttgccctctggcatctttaaaaatcagtgatgaaaaatactaactaaattctgaaggtttcagggaggcgagagttgtggcacttttgctgctcagaggggagctggagtttgacctaccagctctttctagttgtgaatgaggcttgcacctttttttctgaggtgctcgtgagtaactgaggatgccctttgggaggaggtgcttctgagcaggaaggcttgtgtttgtttttagaaactttcaaacccttgtcttgaacacctaagacttgtgtgggtgcctgaagagtaggaaataaacagctatttatatctcggcaacctcgtgatttctgatgacattaaatgaaatgaaacctgccccgagaatcacctcgaatggccaacacccactctctttggggcgcactgtctgactcgctttcagacagtgtgttgaagcagagaattgagacagtgatgtgggttaagtctcaaaacctgctgttgaggaataagatagttttgtgggtttctttttttggtatgcatgatacagattaattatcagccatgagcacatttattagataactgtgattcccattgattttggggttccatacagttaccagtggcagctgcctcctgtctgtgccactcccctgcggtctggctgaggagcttgtgcaaacccagcttggttctttcaactcatgggcgatattttaaagaggcttctgaaatcagcaaaacgtttgtaaatggattcatcttgtttaaagtttcagagagcgcagttttagagttcttttcaaacttaaacacaaagcccagtgggaatttcagcagactttacatgaacttttagagtatttttctcattaatttctttcttttcacaagaattaattttgtgataaaaacaccacatatccagtgtggaaaactaatttaaaaatcagaaaaacaaaaatggaaaataaaaacatcacattctaccacccagaaatcaccattaaggcctcagtgcttaccctttaatgtgtgtatgtgagtgtgtttatatataaattatatagacataaataattaagcacctaattctatatataatttatatatgtacacacacacacacacacacacacatttgctttttacctaaatgatgtcatgttattattttggggacgtttcaggtatgtggaccgacttgcttctttctgaaacaccgttatattttttgctagtataaattaaacttagggttcatttcctccaaagtaaaaattgatttgcttaaagatgaattttcattcagtgacacatgacttaaatgacatcaccactatcatcatcataattcacaaataagacttagcaagttcttaatagtgatgctctataataggaattcaacttacatttccagaaaattaatgaaagatacacttgttccttaaaaaaagagtcggtggccacatacgtttgtaatatgctggtttagacagattaaatgggtttctttccacgggacttctccaagtgttgaccgagctcatgctgtctgtggatctctgggggagacaagggcacgctgtgtttcccaggcctccttgacgcgggaaccttttgttccccccacgggacatgtgggacactagagttccaccacaggtgcttggctctgtggagtcgttggcctcgaggtggtgtccttggcccccagcactgactccggagctctgtgtttgcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcaggtaaggcacctcgttatctgttagaatggaggtggtgatggcctgcctgccacaggggtcagaaaccacagggtccctcccaccccaggctgaggtcttcctcctgttgacttcggcgcccactgggcttggggcttgactccagtagagatcttctgtctggctctgttgtgggcagagagtccggatcagatggtccaggtggaccatggctcaggctgttctcttgcaattctggttttcagcagtcgcctcttaaaacagttccatttcattgcactatgatctcgacaaatacgtctgctgatgtggcggctcttttcaggttcccagaaaaatcataaaggttggaagcatattgttaacattcttggttgtcaggtgtgtcaccctcatgcagatgctggcccacgagtgagacggagggtggagtggactgtactggttttgcacaggagaagttataggagagtgctataagttggctctgtgatatgaacatttctaagcatatttttcagaaccagtgagttttgtttttctaccttggatttcatgacaattcagcgaacctctggctggcttctgtgaagcccctcgccctgtcatgctgggcttcctcactggctttgtggggctgtccaggtggagggagcctcccgcgtgggagggagctgctctacccgccactcgccaccccaccgccaactcttcctctgccttttcccagtcctgtcccttcctgagccccttcagaaactcctgtgtctttgatttctcatgtgcctccccttttcttgaatgtgcttcttcattcaacttatttaaaataaaaatatgacacgtctgtgtgctctggcactgttgacatgtgctcgtacttctgggtgtaagtgacccaagtttttgtaagctcatccagattttcttttggtgcccaaagcaaatatgtccccagataactaagcttcaggccaggtgtggtggcccatgcctgtaatcccagcactttaggaggctgaggtgggcagatcacttgaggccaggagttcaagaccagcctggccaacatggcaaaaccccgtctctactaaagatacaaaaattagctgggcgtgatggtgggcgcctgtaatcccagctactcaggaggatgaggcacaagaatcgcttgaacctgtgggaggcggaggttgcagtgagctgagatcgcaccacggtgctgcagtttgcaggacagagcgagactccattgccccccgcaccacaaaaaaataactaagctcacacagaggctgaccataggaagagggagaactgtgctggttccccgaggcggcggcaagtgaggaagtcacctggggctggacacctctcattctaagggcagaaccatccccaagccctggccagggcggtcccatccttcttggggttgggcatggtgttcatgggggaccaaggaaattgaagggcaactggggggaccccccctcccctgtcagcatctcctgtgtctgccttgggatctggaagagctcacatgggccaggaaggctaaggcccactgggcctggatttctgaagactctggaccttggtgccagtggattcagaagataccacaaggtgagggctttctaatgaaagtgtcacaaggaactggcactggcttttctgagtgcctcttgctgggcgtttttagggaggtagagcccccgtggtgactaagctggaaggtgcacattgagtcacaggtgcactgcgtgagagacagcacaggcagggggtggacgcctgtgagtgtcctggggctgtagacttgcgcgactagaacttactattaatctgtgagcaagagctggtcttggctttcattccttcctctgtaaccaagggctgtgctctttgcccactgcagcctctcacctcaaagtgttcactgaggttcaaggaggatgctgtgaacgtaaaaactgcagctgtgccaaccagcttctgcataattaaggattcccaccaaacactctcatgttatctagggttggagccatgctttctcagagaattgtgccaactcgccattctgattagcctgtgtaggtgtagtctcagatcacggcagtgtgaatgtattttacagattctgactaagtcatttgggtttgatttgaattctggaaaaaaaaaaaagcaggaagtcaaatagtcctgtaagttagctagaaacttctgttcagttgaagagaacagtggagatctttgatatcttcctattcaggtctgcacagcactagggacagcccccagggcccggcccgagggtgtgtatctgataaggacgcgtctgttctgcagaagctgtagcggctcctgtgtcaactcgtttcttttgcgggcgtgacattttattgtagctacaggcagaagatttgtcttgtgtacaggggagggagcatgggctaaagtcaggggatgggcacttgtctttccaacaatgttccagtccgttttgtatcttttgggtaggtgtggtggcttcaggatgtacatgtgtatatccacaagcgggaggccaggggggctgccccactcctgttctcaagtcaagttactgttccatccctggagacaggcaagaagtctactcagagttacacagttcaggcatagtgacagtgggactcagctgccgatggctggtgctcagtcaccacgttgacgttacatattttctgtggtgcctgagttacgtggatgtccgcagtagcacagatactggattatgtgggctctgtagtgagggggggagggtttaaaataatcctgggatgtcgaaacattctgattttttaaatgaaaacttgtccatggcataaattggtcttttgccattgcgtgactacgtttcttgttctttatctcccgacttcactgtggtctactaccttttgaatcttcgtgggtccaatgctgcaaagcagtgttctttagctgtcgactagttcctcttgaagaatcgagggagaccgagggccctggggggaaagcacccaaaggaatgcatacatgctattttgtatctgagatgttcacatcaagagccccactcagcggagtaagagtgctcattcctcttgcagtgttcagaatcacagtaagctcttgcttcctgtttaacctggtgtgttcggtgatgagggtttctgaacatggtctctttcttgtgggcttctacagagctgcaagcgtttgctcaccacggccgctccctgccaagattccaggtgactctatgctttggagaggagtttccagaccctcagaggcaaagaaagctcatcacagctcacgtgagtcctcagttacactcctaccatagtggcttcctgttctttgtaaaggccagagtttcatttagaaaagtcccaaatgaaaagtaaatgtcaaatgacctggaaaaataagcgtaacccttaaactagtgagggaggaagcatggtccaacgagcagcacagtctgaggactcacgtgctcctcccagacttgagatctgctcatcaaagaaccagggaggacagcctcaaaggagggtgcctctttccccatcttttttatttttcaggaaagttgtcgtatttccattttatagggattgaaaaagattgatggttaaagttgccctttaaaattctccaggttaagattgctgtaagaatgctatctagctagtggatcttcattcaatggaaaagcttttcccaaatgagaaactatccattccctggaggcattttgtaggtctctgcagctgtgtcctagcacctcttttatttctggaattttagaaattatttaattattgggcatatgatatttgaaagaggctgaatctttcaaggaattcaagcaaatcagaccctctcgtaatgttctctagcatagctcaagatgggttcaactgtggcaagtaacactaaaagggtagggttaggattagggttagagttttcttttttatgagaaaaggtttccatagataacatgaagcattaatttgccatgggaaacagaatcttgaacccttaagacttttgaatttgaaaacttcacattgctacatacttgcaagcattattaacgggcttgcatgctgagcaataccaggtaaaagttacaccccctaacatcaaagttctcatcatgttctagctctgatgctatttctcattgagaactgaaatgaaacatggtttaatcttgaacatacaaccccccttcttgattttaaaaacaaagaccagccaaccaaccagtatataatcccatagactcaggagttttctcatgagttctctccagtgattgacttaataattgatatgattgttgaaataataactgatacattgttaacaacaggaattgctaaatgactaaataaacttggcattgataagcagcatttaagaagttgatgatcggccgggcacagtggctcacgcctgtaatcccggcactttgggaggctgaggcgggcagatcatgtggtcaggagttcgagaccagcctgaccaacatggtgaaaccccctctctactaaaaatacaaaaattagccgggcgtggtggtgcgcacctgtaatcccagctactcgggaggctgaagcaagggagtcacttgaacccaggagtcagagcttgcagtgagccgagattgcaccactgcactccagcctgggtgacagagtgagactctgtctcaaaaaaaaaacaaaaaaagaagttgatgatcagctcagctatcacatcaatccagttttaaagttgacatggatgcaagtcactgtcctctaagtcagggaaagatggatccccagatgaccccctcatgctgaagacgaggctgcgtggtccataaaatgaataaacacacgtgtacacctatgagttccacttttaaaaattattaatttaattcatttcaggtacttaggagtttagcttaagtcgtcatatataaaatacagtctctaatatcatgattgatggagagcattcagcttgccttagatgctgtaaattcaggaaaagctgaacattaaggcgtttttgttttttggtgagtgtgatccacgctaataaccagacagtataaatttgaggccagttagcttctctttttccacaatagtagttttgttgttgtttaactttactttttatttcttttacctctggttgagaactatacagattacctagaaatcaaatcattcaggatgagctccttgtttctttcaaactgcagttgtggaaaaacaaaatcattggcctaaattaccctgcagattccctcagacttccttttaatttgatcactttacttgatttgatgcagttttagttaaatgtacattttaagtggcagtcgatttgaaagtaacatctttaacccagaattaagtcactttggctgtttttttacatgttgatctatggaaggactaaccaaaaaattgcttctttagatggctccaaatatgaaatgttttgatgtgttctaggatgtaactttgggctttacgttactgtctccttagaatctgagtgctgtttaatagtgagccagttgcaggatatctcagtaatgtctttttaaaatctcttattaaaggtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaa

SEQ ID NO: 14989 - DNA, 2489 bp, Homo sapiens
ttaaatccgggcccttggtcccccgcgcgggcgcgggtggatctctcgggctctgacttgttttcgggtcaccttcaggcttcagccaggcacctgacgcctctttcccctcacggtgccagggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggtgcgtgggggcgccggaggggacccgagtccccgaaaaagtccatttttgtgggcatccctgtctccagtctggtcccgatctgctcttcgcttcccttagagtcacttccccttcgttccccgcctatgggccagatagggaaactgaggcttcagaggggcggggcttcccgaggtcgccaatcccctccctcctgcttcccagcgagcccttggcgttcagttcgcggtgtcagcctccgcctccgagcctcagttgtcttctctgtgaggtgggaatgccggtgaatcctgccgctggcgtggatgagaagtgaatgcgtgctcggagctgcgagtgacagcgggcaggaggcgcccagggacacttggtttctccagggctggaaggcttctagaaggtcaagatcttacgtcttcactgcccctgctcactgtgggactttgagtgacccactctccccctctgggtttcagttcatcagttcaagtggcgtccagccgccctgccttgcacgttgtaaaacgagtgctgtatataataggggtctgggtcgacggtgctgcactacagagtgtcaccctgtggacggtgagccctcaggagggtctcactctccccgtgggccttggcccctgagggtggctgtcagtgtccgctgagcttctgctcctcccgtccctgcccgcaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccaggtactacgggccgggaacgaggccagggtttggcgggtggtcagctctgggaggtccctccagccctgcacgatgttgtcctccatattgatgctgacctgattctccggcctgtcctcctccctccgcctctggggatgggctgctgagccttttcaccagttctttctgcccatctctttttcccagctcccagcccctccaaagatttactttcccatccgtgactcctggaatgcaggtaaggcacccagtttctttgcttggagggagacaccccagtctagcccctctccccacttcctggccattcctttctgtccatcctccttcctgcccgacacgtgtctcttagggatctaaaagggaaaggaggccgagcacagtggctcacgcctgtaatcccagcactttgggaggctgaggtgggcggatcatctgaagtcaggagttcgagaccagcctgggcaacatggtgaaaccccatctctactaaaaatacaaaaattaaccgtgcgtggtggtgcacacctgtaatcccagctgctgcttgagaggctgaagcaggagaattgcttgaacccaggaggcagaggttgcagtgagccgaggttgcaccactgcactccagcctgggcgacagggcgagactccatctcaaaaaaataaaatacaaaaattagcctggtatggtggcgcacttgtagtcccagctacttgggaggctgaggcaagagaatcgcttgaacccaggaggcgaaggttgcagtgagccgagattgcactactgcactccagcctgggagacagagtgagactccatccccgccccccacccaccccccaccgcccaaaacaaactctagagtttcccaggggttggaggctgggtgaggctgggaggggagtatcaccagtggccgtccctttcccacaggcatcatgacggtgatgtcagctctgtcggtggccccctccaaggcccgcgagtactccaaggagggctgggagtatgtgaaggcgcgcaccaagtagcgagtcagcaggggccgcctgccccggccagaacgggcagggctgccactgacctgaagactccggactgggaccccactccgagggcagctcccggccttgccggcccaataaaggacttcagaagtgttccctga

SEQ ID NO: 14990 - DNA, 12835 bp, Homo sapiens
cgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggtaagcttttcttttttggtcaaaaagatttttctcgagaatctcaaacatagagatggtataggtttcttttctgaaaatgatagcaggaaaagggaagacagttttttaaaaggcattctttagaaagctcattgatgggtttttatctaagcaagtataatgatttgtatgtatctctgacatatcattcatatgtacctctgaatcacaaatggactaggaggaataactgctgaccctaaagtattttcttttagctttatgctagccacaggatcttttcatcagtaattttgaatcatcactatctcaaaaattagtgatggcacaaggtcttaagtccttctggaatcaagcagagcttttattaaattatggtcaatatagagttttagttttatctgtatcctagacttacagatgtccagacacaggtagctggtgccatcttatctcattactctctaaacgctcttttgctaaaactctgtctcttctcccattgctgattttgttagacttaagagaatttagggttcagaaaaatgtacgtattgtattttatcaacattatgtgatttaaaaaagactatatttcatctacctttgggaaagaggggactggtgtggggacatacccatcatttacattataaacaaaaatccaggggaaaaaagacttaagcatttggaacatagaatgctaataaattgctattaaaaggcagctttgaatggttggggccaggtgcgggggctcacacctgtaatcccatcactttgggaggccaaggtgggaggatcgcttgagcccaggagttgaactcaagggtagcctgggcaacataggaagacctcatctctacaaataacttaaaaatttagccaggtgcagtggctcacgtttgtaatcctagcactttgagagactgaggtgagcagatcgcttgagcccaggagtttgtgaccagcctgggcaacatggtgaaaccctgtctctacgaaaaacacaaaaattagccagatatgctagcatgcatctgtagtcccatctactcaggaagctggggcaggaggatcacctgagcctggcaggttgaggcagcagtgagccatgattgtgccccactgccctccaccctgggcaacagagaaagaccctgtgtccaaaaaaaaggaaatgaaaaaaaaggttggaatctttctccttgtgcacaggaccacttctgaaaattcctttgggaaagtacagacatcattgtactgcagtgcctggcataactgtcaaaagtagaaatttaagttttaccaacttacttgcaaacaagggatttcataaatatacgagtataatcctttgagattcaaatttgccttttaagttaaacatgataagcaactctaacttagtgagaaatagtgattttgaatgtctagttggcctatttcaactcaaaaaccaacaaggttttcagttttctaatggtaattctgatactaaataacattacaggaaattagactagtaagaattcttaacataggtatgggaccactagcaaaatgtgatgatgaaatagacactgctatttggagtaatatatcagactccactacctgatactcattttatttttttcaatgtaaactttatgtcacatttcacagtattcacataaacttggcacagtggtgcatgcctttaggcccagctactcaggaggctgaggctgaggcaggaggatcacttgaacccaggaattaggagtccagcctgggcaacatagcaagatccttgtctcaaaaaaaaagactattcacgtaatttcaagaatgataatggaagtttttggtatactttaaagaagaatctcttcatgtttctggtaatgggcctgttgtttggaccctattttaacataaaacaataggcttaagagcttagttttcattttcatggaatttttgggttccattttagtacagaaatcatgaggatccaaagacgctcctatgattatttggtttttcatttttatttcacatagtcaagtctttgatataaaagattcagaaagggactagatcttagaacacttcaaagagctgtcttgccttcctcagtcttataggccagtgatatatgagcattttttcaaaattttaaaactatggttcgagtagataattaaaaagttaagagccactaccagagttatgctaggtttattgtcagaattttttatatttttaagatttgaccacttcatcaagttcatctggtcctagagtttctggctcaccttgtcatcatagtgattctaattcttctgagaaacacatgtcacgagcctctcaaagagaaggtaggttaaaagttggattttataatcttgtaacaacagattatgccaatctgattaattattgattgattaaaaccagttttatggttttaatccataaaaataaaagcaatggagatgaggtgatttatccctcagtcatcatcttcaaaaagctaaccgagagtccctggggttgaatatcttgagttaaatcttaatagaacttgagctttggttttattagctggacttagtttggtctagtttggagaggaagtagttcagaaatatagatttcaatcaagattgttgtgaaaattaagtgagattatgcacgtgaaagctctgtataaatataagtcatgaattttcaggtaattgtgaaagtcacctggttaccctcagactttttgctctgccatttccttgtctgtgcaatgcctgacagcttccaagggtttgtaggataaagtgagctaccatctggctcctctctgtatttcccagttttttcctagccattctggcagaactagttgctctgccctataccttccaccacacccccccagttgaaatggtttctgcctatacaaattccacatactgttcctcttcatactaactgacgtctaagctcttataccattcattgtttattcttctctttgtgaactgagtattaagagccagagatggcttgcttttttttttgtcattttgggtcacttttggagatagacatttctctaccttgttattttgggcagagactaaatcttagacttctaatttgtgttttcactgggtggctttgcctagtagatgctggttatcttgcatggctacttatgtcagtagaatggtttaagagctctttctaacctatatggcctatccacttgcctctggatattgaagtctgtgatatttcactttaaggttaaaggctcctcctcttaaatttaaagatttatgcccagaagtataacatttttcctttgatttgtaacacaaacatcttttgcagattcttcctgttctccttccacttgtgctatgggaaacaagtcaaggcttctaataatcattgagaaaaatctttattgattgactacaccatccacaagaaaaagaaacttaatttaagaagaatagttaacatgcttgcttgttattgaccagtggtaaacacacaaacacaaatatacagcagttctatgccacagagagttaagaatgagggaagagatgatatatgaggaggctgggaagaagaggaaaatgagagggtgaaaagagagggaaaacatgggagaaggtggggcttataggtgaagttgctctaaatgttggaaatcctggatcttcagatgtcagagtatgttaacactatcctttggcagatataatagctgtatagagcagaggctttcaaatgcatttcagcattagaactctatttttgacatgaaatctgctgtggattcttagagatgtagcacaaataaaatcaaagtagctctggttcaagaaaaattagggaggctcttgaccctccagccttccccactccatctacacctcagcccacacgtggttccccacttttgccatctcctgaggaaccccaaaggagcacagttagcaaaccacctacttagaatgcatttcttgtctggttttgttataggttttccaaattaattcttaaaataagagtatatttttctctaaaattgttaaagttcaatcatatgtgaaatagttatttcagtatagttttgttatagcagtgtaatttagagcttcacaggtttctgttaatgatgtagtaatctgaagggaatctttagaaagaaggtaacacatctgcttgacaagcaattcacaaaggatctgacagagggagctcaataccttcaaaataactccttccacagtcagagaagtgttgaaatatttctcttgctattaaatttctaagttgcttccttacagtgtctatgaaagtggtttttcacgcacctgaaggatataacatattcctattattaacagtgccttactccagcagtcattttcattgggagttaggtagaaggaaatgatgaggcatagtagagtctatgattggcaatgtctcccatcccttgttttgacatgcctttatgtgaggtgtcctttcttacctccaacattttattttttgtttatagtgttgttattgcaggtgcttaagtcctgatctttttatttgcttaaaaggcaatcctcatggcttccaagtatttccttctctggaccagaaagcaccaggaccaatgagaggagaattgttaccttttacctttctagagtcctttcatgtcacataactttggttcttacttaaataaagagctttctgagatgtaagatccaaataaaagaacccctagtcagcttctatgccttagccttaggtcagtgacaattactgctgtgggaacttggatcttttgttctatttataccctttccccacaccttcaccccgccaaaactcacacaccatacattggggagtaccacgctctttaacatatggtagcataaggggcagactaaggaatgacggcatgggaggtggctgccagaaataaaaagctttgatgaactgccttagttttttgataatacaaatcccacatcctcattttcttatatctcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggaggtacaggcagcagcactccaccttcaacagggctcattggacaaattgccattgccgtgtgtgcagagcttaggccgatcgctgactgcagtctctgccttcaagggcatactgctagagatcctgcttctcgactctcctgtttctgtcctctcttgcttcatatggtatcattatcccttccaaactcttcttattcctctcctgctggggttgagcaaggtgggaggtactttaaaggccagcatcagctcagtttttgcccagcttcttaaatcttgcctctttcatctcaccctaaacaaacaaacaaacaaacaaacaaaaaccccttgtataataaacataggtctgaaatgtttcagctaagctggctaaatgtgagattttactaagccaattgagtatcataattttctttttttaaaaaccaggggaaactctgggaaaggaagggactatactgatgactagggggaaaggtgttaaatgactttatgattctcatcactctggaaagcaagagtcttccaaggatctcactggtcctagaggccacaactgaaaggagagaagagaagagcctttgaattgtgtaggggaagaggtaagatactctagggcttggatgtactccaggaatttttaaaatatcaacattgttgttgcccttagaaaagagaatgtattactgcaaaagtcacaggcagcctcagggaacaaaaggctttaaagcatcataacacagaataacctcagcttatgaagataagaaagtagggggcctacaagttttgttagttgggagggggatagcattattctgagtgatttcttgtaaaaattctgtggctttggcaatctgttgagctttttaaaaataaggaatatctgtagcactatttgggctctgtaaccttggtttgtctcccttctctccccctagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaaattcttctctacccatttgggcttaagacaattcccagaaagtgttttcattatttaaaaaataataatagtaaatgaaagcaattttagaggtggaaaataccttagaatggaatcatttgcattatttgacaaatgagagaagtgacatgacttgcctaaggtcatcctgcaaagttagtggcagagttaggacttgaattccagtcttctaattccttggtcagggcaatttctactgtgttatgctgtctgttagaaataatgacttatggacactttgtctttaagttgtattattgtaaatacccttaaactggccaatagattttagaaaggcaggcatgggagtagatgctgagaattctagccataagaagaaaagtattttaaatcttacagaaatgtttaaacaacccaaaatacatgaataaaaatgacatttctttgtaggacctgccaactaactattcacacacatttatagaggttataaggatcttggctctagaacaaatttttgaaattagatcattttaccatggatgttaacaaaattggaaattttttgtcactgagaaaattatcacaaagcacagtaaatacatatacttaccatacattttgtaaaaaacacattttttaaagaaaatagggatgggtatggtggctcacgtctgtaatcccagcactttgggaggccaaggtgggaggttcacttgagcccaggagttccagaccagtctgggcaacatggcgaaaccccatctctaccaaaaatacaaaaattagatgggcatgttggtacacgcctgtagtcctagctactcaggaggctgaggtgggaggatggtttgagcctgggaggcagaggctgcagtgagccaagattgcactattgcactccaccctgggcaatagagccagatcctgtctcaaaaaataaaaatagactgggcatggtggctcatgcctgtaatcccagcactttgggaggctgaggtgggtggatcacttgaggtcaggagtttgagaacagcctagccaacatggtgaaaccctgtctctaccaaaaatacaaaaatcatagccaagcgtggtggcaggtgcctgtaatcccagctactcaggaggctgaggcaggagactcgcatgaacctgggaggcagaggttgcagtgagccgagatcgcaccactgtactctagcctgaccagcagagcgagactctgcctcaaaaaaaaaaaaaaaaataaaataaaataaaattagttttggaggtgaaaacacccaaactgttattatttaaaaatacctaccaagtactgtggtcatattgacattcaaaagaagtttcataaatcgtatcaactctggaaagagttcatgtcagatgctagaccagcaagttacccaactcaaaattcagccaatgattctttactatagagtacctatcatgtgtcaaataatatacagacttcactactaaccctcacaaaaacttgcagggtaggtggaatgagccccaatttaatttggaggtaatagtgggtcagaaagattaaatgacttgccttaagtcatagagttagcagtgagtggcagcactgggattcaaacccaggtttgtgtcttgtccaaagcctgtgcttactgctttaccattgtgctctttagtttgtaaagtatggtaagctggcctgttatttgtttagtatcttctggattttttttttttaattatagagctagcttaccgtgtgtatcatgtaaaaaaaattcataagattaacaatttccatgagaatatcataaactcagggcacacattctggccattcctgactaaaaaacttcaagcagaataagcagctataaaatagaaaagaaaaattaaggataaacggcattgtgaaaaaaaaccgagccacacagatgagaattaaaaattaacagccagcaaactcaaaagaacctttgtcctccttgagatatggtgatgatcaaaaagttagcaaggaatattaatcaaggaattaaagggcattaggaatgctatagtattggaagaaattacatcttaacatttcaaagccccatttcacttaagagtaaaatctaatctgatgttttttactctgaattttattcagtaatttttattcataattcatgataattggtaatgtagtataattgttagtaaatgcagtacaaattgttctactgttttaaaaagttttccgcagaacagtgcatttatggcaatgctatgtttaatgagttagggacatcaaatatatagtagttccttattttcagttgtgaaaatgaaatggctaaagcagaagagacgtctattttagtcttttaaaaatgtgtgtgggtggtcttttttcctcagaagcccaaagcacatgtatattttgttatttctccttgctatattcctgagactatactaaaaactttaagaaaaggaacaagaaaaaggtaaattcatgtgttccccactgctgtgtctagaaccaagatcacattatatcattgttaaaattgtgttatctagaaagtgcaatatagggaaaacactctaagaatcttttaaaagcctagtgtttcccttatttgtcagaatatgtggtagtggcatccataagtatcttttaacttgcatttagcaggacaaatagtgtgatacttatactgatgacaatcatccccatttaatgaccagcagtcactgagcgctgtgaaaattcactcagtgataccccgtgttggtcttgaaggaaaccgtacatatgaatttttggatagctaatgtatatctctcaagtgccaacatttaaaacttgtaattatttttgatgtgagtatttcaggtatgttagtataccttcctgccttcttcttaaacatcatgctcagtataattcacattttcatgatgaaaagttaaagttatattcataatgtattattataagtatccagctctgatgtatgtaaaacacttcataaaatgtaaagggctataacaaatatgttataaagtgattctctcagccctgaggtatacagaatcatttgcctcagactgctgttggattttaaaatttttaaaatatctgctaagtaatttgctatgtcttctcccacactatcaatatgcctgcttctaacaggctccccactttcttctaatgtgctgttatgagctttggacatgagataaccgtgcctgttcagagtgtctacagtaagagctggacaaactctggggggacacagtctttgagacagctcttttggttgctttccacttttctgaaaggttcacagtaaccttctagataatagaaactcccagttaaagcctaggctagcaattttttttagttgcaactaagtaagatatactacaaactaaggatgctgctagactaaggaataaacagcaaggtaccaaagtacagcaaagcaacaacaaaggctctgtatttgcagaggggtctatcatgcttttaagaaaaaagaagagtacaggaaaaaaattcagatagacataagagtattttggatgccattaaactttgtcaataaccattaaaacataggcttaaattatcacgtattgttacaaagacacagttttgtctcattataaaataagattatatgaaatttatattctagaaatgattccaaatcatgtcctaagaatttctcccattcaaatgataatggaaattactgtcaaaaggaaaatctcaaagttaccattacgctgctctcttgtaaatgaactagggataaagatatgggttttatcaaaagccctaaggaatatatctcacattcacctcctatatgtatgtgtatatataaatgccactataaatgaaaatgtcacccagagataataaaataatttttaaagtttaaatctggtccaaagtctttaaaataggtagattttcagctttcttaagtttctccctcatttagatttcatggtttttacataaagggtgaatatttgaattttcttttaaatttcactgcatcttcaattgcccaactgtgtttcctgataaattttagattcacatttttaggaaatttggagtattccagacaatatactagatacccagaaacttttctcagtaggttctgaggtgttttaagttcttatgctagactgtaagctccttgagggcagagactgttttatttattcttgtatcctcagtgcctggtacaggacttgacacagagtagttgttcaataaatatttgttgaatgaatcaaa

SEQ ID NO: 14991 - DNA, 12892 bp, Homo sapiens
aggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggtaagcttttcttttttggtcaaaaagatttttctcgagaatctcaaacatagagatggtataggtttcttttctgaaaatgatagcaggaaaagggaagacagttttttaaaaggcattctttagaaagctcattgatgggtttttatctaagcaagtataatgatttgtatgtatctctgacatatcattcatatgtacctctgaatcacaaatggactaggaggaataactgctgaccctaaagtattttcttttagctttatgctagccacaggatcttttcatcagtaattttgaatcatcactatctcaaaaattagtgatggcacaaggtcttaagtccttctggaatcaagcagagcttttattaaattatggtcaatatagagttttagttttatctgtatcctagacttacagatgtccagacacaggtagctggtgccatcttatctcattactctctaaacgctcttttgctaaaactctgtctcttctcccattgctgattttgttagacttaagagaatttagggttcagaaaaatgtacgtattgtattttatcaacattatgtgatttaaaaaagactatatttcatctacctttgggaaagaggggactggtgtggggacatacccatcatttacattataaacaaaaatccaggggaaaaaagacttaagcatttggaacatagaatgctaataaatttttattaaaaggcagctttgaatggttggggccaggtgcgggggctcacacctgtaatcccatcactttgggaggccaaggtgggaggatcgcttgagcccaggagttgaactcaagggtagcctgggcaacataggaagacctcatctctacaaataacttaaaaatttagccaggtgcagtggctcacgtttgtaatcctagcactttgagagactgaggtgagcagatcgcttgagcccaggagtttgtgaccagcctgggcaacatggtgaaaccctgtctctacgaaaaacacaaaaattagccagatatgctagcatgcatctgtagtcccatctactcaggaagctggggcaggaggatcacctgagcctggcaggttgaggcagcagtgagccatgattgtgccccactgccctccaccctgggcaacagagaaagaccctgtgtccaaaaaaaaggaaatgaaaaaaaaggttggaatctttctccttgtgcacaggaccacttctgaaaattcctttgggaaagtacagacatcattgtactgcagtgcctggcataactgtcaaaagtagaaatttaagttttaccaacttacttgcaaacaagggatttcataaatatacgagtataatcctttgagattcaaatttgccttttaagttaaacatgataagcaactctaacttagtgagaaatagtgattttgaatgtctagttggcctatttcaactcaaaaaccaacaaggttttcagttttctaatggtaattctgatactaaataacattacaggaaattagactagtaagaattcttaacataggtatgggaccactagcaaaatgtgatgatgaaatagacactgctatttggagtaatatatcagactccactacctgatactcattttatttttttcaatgtaaactttatgtcacatttcacagtattcacataaacttggcacagtggtgcatgcctttaggcccagctactcaggaggctgaggctgaggcaggaggatcacttgaacccaggaattaggagtccagcctgggcaacatagcaagatccttgtctcaaaaaaaaagactattcacgtaatttcaagaatgataatggaagtttttggtatactttaaagaagaatctcttcatgtttctggtaatgggcctgttgtttggaccctattttaacataaaacaataggcttaagagcttagttttcattttcatggaatttttgggttccattttagtacagaaatcatgaggatccaaagacgctcctatgattatttggtttttcatttttatttcacatagtcaagtctttgatataaaagattcagaaagggactagatcttagaacacttcaaagagctgtcttgccttcctcagtcttataggccagtgatatatgagcattttttcaaaattttaaacctatggttcgagtagataattaaaaagttaagagccactcccagagttatgctaggtttattgtcagaattttttatatttttaagatttgaccacttcatcaagttcatctggtcctagagtttctggctcaccttgtcatcatagtgattctaattcttctgagaaacacatgtcacgagcctctcaaagagaaggtaggttaaaagttggattttataatcttgtaacaacagattatgccaatctgattaattattgattgattaaaaccagttttatggttttaatccataaaaataaaagcaatggagatgaggtgatttatccctcagtcatcatcttcaaaaagctaaccgagagtccctggggttgaatatcttgagttaaatcttaatagaacttgagctttggttttattagctggacttagtttggtctagtttggagaggaagtagttcagaaatatagatttcaatcaagattgttgtgaaaattaagtgagattatgcacgtgaaagctctgtataaatataagtcatgaattttcaggtaattgtgaaagtcacctggttaccctcagactttttgctctgccatttccttgtctgtgcaatgcctgacagcttccaagggtttgtaggataaagtgagctaccatctggctcctctctgtatttcccagttttttcctagccattctggcagaactagttgctctgccctataccttccaccacacccccccagttgaaatggtttctgcctatacaaattccacatactgttcctcttcatactaactgacgtctaagctcttataccattcattgtttattcttctctttgtgaactgagtattaagagccagagatggcttgcttttttttttgtcattttgggtcacttttggagatagacatttctctaccttgttattttgggcagagactaaatcttagacttctaatttgtgttttcactgggtggctttgcctagtagatgctggttatcttgcatggctacttatgtcagtagaatggtttaagagctctttctaacctatatggcctatccacttgcctctggatattgaagtctgtgatatttcactttaaggttaaaggctcctcctcttaaatttaaagatttatgcccagaagtataacatttttcctttgatttgtaacacaaacatcttttgcagattcttcctgttctccttccacttgtgctatgggaaacaagtcaaggcttctaataatcattgagaaaaatctttattgattgactacaccatccacaagaaaaagaaacttaatttaagaagaatagttaacatgcttgcttgttattgaccagtggtaaacacacaaacacaaatatacagcagttctatgccacagagagttaagaatgagggaagagatgatatatgaggaggctgggaagaagaggaaaatgagagggtgaaaagagagggaaaacatgggagaaggtggggcttataggtgaagttgctctaaatgttggaaatcctggatcttcagatgtcagagtatgttaacactatcctttggcagatataatagctgtatagagcagaggctttcaaatgcatttcagcattagaactctatttttgacatgaaatctgctgtggattcttagagatgtagcacaaataaaatcaaagtagctctggttcaagaaaaattagggaggctcttgaccctccagccttccccactccatctacacctcagcccacacgtggttccccacttttgccatctcctgaggaaccccaaaggagcacagttagcaaaccacctacttagaatgcatttcttgtctggttttgttataggttttccaaattaattcttaaaataagagtatatttttctctaaaattgttaaagttcaatcatatgtgaaatagttatttcagtatagttttgttatagcagtgtaatttagagcttcacaggtttctgttaatgatgtagtaatctgaagggaatctttagaaagaaggtaacacatctgcttgacaagcaattcacaaaggatctgacagagggagctcaataccttcaaaataactccttccacagtcagagaagtgttgaaatatttctcttgctattaaatttctaagttgcttccttacagtgtctatgaaagtggtttttcacgcacctgaaggatataacatattcctattattaacagtgccttactccagcagtcattttcattgggagttaggtagaaggaaatgatgaggcatagtagagtctatgattggcaatgtctcccatcccttgttttgacatgcctttatgtgaggtgtcctttcttacctccaacattttattttttgtttatagtgttgttattgcaggtgcttaagtcctgatctttttatttgcttaaaaggcaatcctcatggcttccaagtatttccttctctggaccagaaagcaccaggaccaatgagaggagaattgttaccttttacctttctagagtcctttcatgtcacataactttggttcttacttaaataaagagctttctgagatgtaagatccaaataaaagaacccctagtcagcttctatgccttagccttaggtcagtgacaattactgctgtgggaacttggatcttttgttctatttataccctttccccacaccttcaccccgccaaaactcacacaccatacattggggagtaccacgctctttaacatatggtagcataaggggcagactaaggaatgacggcatgggaggtggctgccagaaataaaaagctttgatgaactgccttagttttttgataatacaaatcccacatcctcattttcttatatctcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggaggtacaggcagcagcactccaccttcaacagggctcattggacaaattgccattgccgtgtgtgcagagcttaggccgatcgctgactgcagtctctgccttcaagggcatactgctagagatcctgcttctcgactctcctgtttctgtcctctcttgcttcatatggtatcattatcccttccaaactcttcttattcctctcctgctggggttgagcaaggtgggaggtactttaaaggccagcatcagctcagtttttgcccagcttcttaaatcttgcctctttcatctcaccctaaacaaacaaacaaacaaacaaacaaaaaccccttgtataataaacataggtctgaaatgtttcagctaagctggctaaatgtgagattttactaagccaattgagtatcataattttctttttttaaaaaccaggggaaactctgggaaaggaagggactatactgatgactagggggaaaggtgttaaatgactttatgattctcatcactctggaaagcaagagtcttccaaggatctcactggtcctagaggccacaactgaaaggagagaagagaagagcctttgaattgtgtaggggaagaggtaagatactctagggcttggatgtactccaggaatttttaaaatatcaacattgttgttgcccttagaaaagagaatgtattactgcaaaagtcacaggcagcctcagggaacaaaaggctttaaagcatcataacacagaataacctcagcttatgaagataagaaagtagggggcctacaagttttgttagttgggagggggatagcattattctgagtgatttcttgtaaaaattctgtggctttggcaatctgttgagctttttaaaaataaggaatatctgtagcactatttgggctctgtaaccttggtttgtctcccttctctccccctagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagcgtgcagtaagccgagattgcaccactgcactccagcctaggcgacagagcgagactctgtctcaaaaaaaaaaaaaaaaaaaaaaaattcttctctacccatttgggcttaagacaattcccagaaagtgttttcattatttaaaaaataataatagtaaatgaaagcaattttagaggtggaaaataccttagaatggaatcatttgcattatttgacaaatgagagaagtgacatgacttgcctaaggtcatcctgcaaagttagtggcagagttaggacttgaattccagtcttctaattccttggtcagggcaatttctactgtgttatgctgtctgttagaaataatgacttatggacactttgtctttaagttgtattattgtaaatacccttaaactggccaatagattttagaaaggcaggcatgggagtagatgctgagaattctagccataagaagaaaagtattttaaatcttacagaaatgtttaaacaacccaaaatacatgaataaaaatgacatttctttgtaggacctgccaactaactattcacacacatttatagaggttataaggatcttggctctagaacaaatttttgaaattagatcattttaccatggatgttaacaaaattggaaattttttgtcactgagaaaattatcacaaagcacagtaaatacatatacttaccatacattttgtaaaaaacacattttttaaagaaaatagggatgggtatggtggctcacgtctgtaatcccagcactttgggaggccaaggtgggaggttcacttgagcccaggagttccagaccagtctgggcaacatggcgaaaccccatctctaccaaaaatacaaaaattagatgggcatgttggtacacgcctgtagtcctagctactcaggaggctgaggtgggaggatggtttgagcctgggaggcagaggctgcagtgagccaagattgcactattgcactccaccctgggcaatagagccagatcctgtctcaaaaaataaaaatagactgggcatggtggctcatgcctgtaatcccagcactttgggaggctgaggtgggtggatcacttgaggtcaggagtttgagaacagcctagccaacatggtgaaaccctgtctctaccaaaaatacaaaaatcatagccaagcgtggtggcaggtgcctgtaatcccagctactcaggaggctgaggcaggagactcgcatgaacctgggaggcagaggttgcagtgagccgagatcgcaccactgtactctagcctgaccagcagagcgagactctgcctcaaaaaaaaaaaaaaaaataaaataaaataaaattagttttggaggtgaaaacacccaaactgttattatttaaaaatacctaccaagtactgtggtcatattgacattcaaaagaagtttcataaatcgtatcaactctggaaagagttcatgtcagatgctagaccagcaagttacccaactcaaaattcagccaatgattctttactatagagtacctatcatgtgtcaaataatatacagacttcactactaaccctcacaaaaacttgcagggtaggtggaatgagccccaatttaatttggaggtaatagtgggtcagaaagattaaatgacttgccttaagtcatagagttagcagtgagtggcagcactgggattcaaacccaggtttgtgtcttgtccaaagcctgtgcttactgctttaccattgtgctctttagtttgtaaagtatggtaagctggcctgttatttgtttagtatcttctggattttttttttttaattatagagctagcttaccgtgtgtatcatgtaaaaaaaattcataagattaacaatttccatgagaatatcataaactcagggcacacattctggccattcctgactaaaaaacttcaagcagaataagcagctataaaatagaaaagaaaaattaaggataaacggcattgtgaaaaaaaaccgagccacacagatgagaattaaaaattaacagccagcaaactcaaaagaacctttgtcctccttgagatatggtgatgatcaaaaagttagcaaggaatattaatcaaggaattaaagggcattaggaatgctatagtattggaagaaattacatcttaacatttcaaagccccatttcacttaagagtaaaatctaatctgatgttttttactctgaattttattcagtaatttttattcataattcatgataattggtaatgtagtataattgttagtaaatgcagtacaaattgttctactgttttaaaaagttttccgcagaacagtgcatttatggcaatgctatgtttaatgagttagggacatcaaatatatagtagttccttattttcagttgtgaaaatgaaatggctaaagcagaagagacgtctattttagtcttttaaaaatgtgtgtgggtggtcttttttcctcagaagcccaaagcacatgtatattttgttatttctccttgctatattcctgagactatactaaaaactttaagaaaaggaacaagaaaaaggtaaattcatgtgttccccactgctgtgtctagaaccaagatcacattatatcattgttaaaattgtgttatctagaaagtgcaatatagggaaaacactctaagaatcttttaaaagcctagtgtttcccttatttgtcagaatatgtggtagtggcatccataagtatcttttaacttgcatttagcaggacaaatagtgtgatacttatactgatgacaatcatccccatttaatgaccagcagtcactgagcgctgtgaaaattcactcagtgataccccgtgttggtcttgaaggaaaccgtacatatgaatttttggatagctaatgtatatctctcaagtgccaacatttaaaacttgtaattatttttgatgtgagtatttcaggtatgttagtataccttcctgccttcttcttaaacatcatgctcagtataattcacattttcatgatgaaaagttaaagttatattcataatgtattattataagtatccagctctgatgtatgtaaaacacttcataaaatgtaaagggctataacaaatatgttataaagtgattctctcagccctgaggtatacagaatcatttgcctcagactgctgttggattttaaaatttttaaaatatctgctaagtaatttgctatgtcttctcccacactatcaatatgcctgcttctaacaggctccccactttcttctaatgtgctgttatgagctttggacatgagataaccgtgcctgttcagagtgtctacagtaagagctggacaaactctggggggacacagtctttgagacagctcttttggttgctttccacttttctgaaaggttcacagtaaccttctagataatagaaactcccagttaaagcctaggctagcaattttttttagttgcaactaagtaagatatactacaaactaaggatgctgctagactaaggaataaacagcaaggtaccaaagtacagcaaagcaacaacaaaggctctgtatttgcagaggggtctatcatgcttttaagaaaaaagaagagtacaggaaaaaaattcagatagacataagagtattttggatgccattaaactttgtcaataaccattaaaacataggcttaaattatcacgtattgttacaaagacacagttttgtctcattataaaataagattatatgaaatttatattctagaaatgattccaaatcatgtcctaagaatttctcccattcaaatgataatggaaattactgtcaaaaggaaaatctcaaagttaccattacgctgctctcttgtaaatgaactagggataaagatatgggttttatcaaaagccctaaggaatatatctcacattcacctcctatatgtatgtgtatatataaatgccactataaatgaaaatgtcacccagagataataaaataatttttaaagtttaaatctggtccaaagtctttaaaataggtagattttcagctttcttaagtttctccctcatttagatttcatggtttttacataaagggtgaatatttgaattttcttttaaatttcactgcatcttcaattgcccaactgtgtttcctgataaattttagattcacatttttaggaaatttggagtattccagacaatatactagatacccagaaacttttctcagtaggttctgaggtgttttaagttcttatgctagactgtaagctccttgagggcagagactgttttatttattcttgtatcctcagtgcctggtacaggacttgacacagagtagttgttcaataaatatttgttgaatgaatcaaa

SEQ ID NO: 14992 - DNA, 614 bp, Homo sapiens
gcagattattccgtaatagaggaatccatcatttattattataattaacagactatattcatcagggtaagatctgttctgaccataagcaagcaaacatttctcattgacttggaaaactgcaagttaagactcagtttttcattcaacgaacatttgaatccctattatatgcctagtttagtactgggaactcaagggacaaagataactatcgtcttggtattccatagctgtagttgaaagagatttagattcagggctggcttaaagaggttgtacatgtgcagttacatagtgtcccatacttagaaagattccatgtaggctgggtgcagtagctcacacctgtaatcccagcactttgggaagccgaggcaggaggatcgcttgagcccgggagtttgagaccagcctggggaacataatgagaccccatttctacaaaaaatgaaaacacaattagccaggcatggcggcatacacctatagtcccagctactcgggaaactgaggtgggaggatcacctgagcccaagaagttgagactgcagtaagctgagagcacaccactgcactccagcctgggcaacagagtgagattgcctcaaaaa

SEQ ID NO: 14993 - DNA, 614 bp, Homo sapiens; identical to SEQ ID NO: 14992

SEQ ID NO: 14994 - DNA, 25550 bp, Homo sapiens
ctactgtcatcctacaaggaggggctcttggaccagcagcaaggggatgtgaagacgggagccatgaagaaccttctggctcccatggacaccgtgcttaacaggctggttgatgctggctactgtgcagcatcccttcatacctctgttgtggccaactcagtggccttgctgtataagctctttctagattcttactttaaggagggaaaccagcttctctgcttccaggttctccccaggttgtttggctgcttgaagatttcacacctgcaggaggagcagagcaaagccctgtccacatcagattggaccacagagcttttggttgtggaacagctactaaactcagtggccaacaacaatatctacaacatcgctgccgacagaattcggcacgaagaggctcagttccgcttttaccgccacgtggctgagctgctgataaaccatgcacaagcacccataccggcctggttccgctgtctgaagactttgatatctctgaatcatttgattttggagccagacctggatgacctgctggcttcagcgtggatcgatgccgaggtaacagagtttcgaaccaaaaaagcccaggaggcgcttattcgtactgtcttccagacttatgccaaactccgacaagtgccacggttgtttgaagaggttttgggggtgatctgtcgtccagctgctgaggcactgaggcagcctgtgctggcctcgggcccctccacggtactctctgcatgcctcctggagctgcctccaagtcagatcctggacacgtggtcccttgtgctggagaagttccagtctttagtcttgccctatttgcagagtgatgccgacatggccctgaaatcactgtcactgagcttgctgctgcactgcatcatgttcaacatgaggagcctggacagcagcacgcctctgcccattgtcagacggacacagtgcatgatggagaggatgatgagggagctcgtgcagcccctgctggcccttctcccggacaccccaggcccagagccagagctgtggctgcagaaggtcagtgactctgtgctcctgctctcttacacttgggcccaggtggacgctatgttcagtttgaactgtagccagtatcactctatgtctgggccccttataggtgttgctctggagatctcgaacctcccttcgttgctcccaggtgtaaaaacacagcattggaagaagatagagaagtttacagctcagttcagctctcttggtacatattgcttagaacagctgtacctgcagaaaatgaaaaggactttaatgcaaactagtttccggtctgaaggagccatccaaagtttgaggtgcgatgctgcctttattattggttccggcagaaaaagcttgaatcagagaacgacggcttcctgggatggccaagttgggatggtgagtggactcacataccctgtagcacactggcacttgattgtgtcaaatctcacaattttaatatcctatctgtgtccagatgatgtgggatacctggccagtgtcctgctgagaactttacccatgggcaaagcccaggaagtctcaatagatgaagaggcatacatcacactggaaaaaatatccaaagccttccttcatagccctctctttccagagatgcagtcccttcattctgctttcttaacgtgcgtaaccacaagttgctccagcattctgtgttctggtgcccagcgtgactcaggtcttgtcagtcagcagcttccctggctttttgaaaaggaccacatggttgtgggtcattgggaaaacagatttgcaaaagctggacccgaaggtatagaacctagaggagaaattgcccagaacttactgtccctggtcaagagtgacttccctatccagctggagggagagcagttggaaagcatcctggggcttttggaagtgatttctgccttacagctggacagcctcttgccaccctatcatgtgcattattttcttgtgttactgtccatggccgtcaccaaactaggatgctcttgctcctcctcactggctctcaagttcttgacgacttgctaccaacttcttggttacttgcaaaaggggaaaagtgctcgctctgtgttcaagatcatgtatggtagtgatatttttgaggttgtactgacctcattgttcagagctagtagtaggttccttattgagatggatgatcccgcttggctggaattcctccaagtgatagggacgttcttagaggagctaatgcagatgctcatccaaatgaagctgagcttggtgctcaattttagaaaaatcaccgcattcctctctagttccaaaccatacacggaggcagcttcaagcaaacaattagaaaatcagaacccccagggcaggcagctccttctggtgtctttaaccaggttgtgccatgtcctgggacctttcctcaaagagcagaagctgggccaagaggccccagcagcactgtctgagctgctgcagcaggttgtgctgcagacaggagctgtgctgcagctctgctcagtgccgggggcccggggctggcgccttccctcggtcctcatctcatccgtcagcacgctcttggaagccgacctgggtcagcactgcagggatggaggggccgacatttcccaaggaagcgacaggacgctgctctcccatgttgccctctaccagggtgtttactctcagatactgttggagttgccagctctcgcgggacatgatcagtcttttcaggcagccttgcagtttttgactctgttctttttggccccagaactgcatcccaaaaaggactccgtgtttacctccatgtttcattctgtgagaagagttcttgcaggtaagatattttctcttgagctaattctgtgttatagaggtctggtttccactgctcccctttttggaactgggaataagtgaacacgtgatgtgttcaaaaggtaccacatgtgcggctgggtgcggtggcttacacctgtaatcccagcactttgggaggccgaggcgggcggatcacaaggccaggagatcgagaccatcctggctaacacggagaaaccccatctctagtaaaaaatacaaataattagccgggtgtggtggcaggcgcctgtagtcccagctactcgggaggctgaggcaggagaatggcgtgaacccaggaggcagagcttgcagtgagccaagatcgcgccactgcactctagcttgggcgacagagcgagagtctgtctcaaaaaaaaaaaaaagtactacatgtggacagtgagaagacctcccttctaggcccagcacccacgacttcatgccctctatttacattctaggcgtacataagcaattactgctacaacggtttccttgctttctgtgcaaacagcagcctcctccgtatgttgctctgcacctcagttgctcactgattttggaggttgctctgtgtacgtttatagttttgaaatctgctcctcttcagctttttagcctttaacttgtcctggctgcaatgagatacatagatacctgcatccttagtaggttcttatgtatcagactttcagtgccataaattgactttaaaaagatatgaaaatctgccaactttaaaaaagtacaaatcagagccaggcgtggcagctcacgccagtaatcccagcactttgggaggctgagggggcagattgcttgagtccaggcaacatggcaaaaccccatctctacaaaaaatacaaaaattggccaggcatggtggcatgcgtctgtagtcccagctactcaggaggttgaagtgggaggatcacctgagcccagggaggtcggtgctgcagtgagtcttgatcctgccattgtactccagcctgggtgacacagtgagatcctgtctcataaaaaaataaattaaaaaaagtacaaatcacttaatttcttttttttttttttttgagatggagtctcactctgtctaccaggatggagtgcagtggtgcaatctcagctcactgcaagctccgcttcccgggttcatgccattctcctgcctcagcctcccaagtaactgggactactggcacccgccaccacgcccggctaatttttttgtattttttagtaaagacagggtttcaccatgttagccaggatggtctcgatatcctgacctcattatccgcccacctcagcctcccaaagtactgggattacaggcgtgagccaccatgtccagccaaatcacttaatttccaaagagcctcttacagttccttgaggacaggactgtgccttccttagttcacccctgtccccccaccatattagggtgctgccaggtgcaagtgctcactggaccaaggctaaccttcaatgtcatcaaagtgttttagtctgaaggcagccttccaagcagcaaactaggacctcgtacacagcctcgaagcaagagagctcatgtcttcctgcacagagtcgacctttacagcccccctggtgaaaggttaatgggttactatgcagccgttaaaaatataattatgaaaactattatgaagacaagggctagaaatatctagaaaatattaagcaaaaaaagtacagtatgaaatgttaaatatgccacaattacagctatataagatatacatgcgtgcagacaaaggctagaaacccatccaaaaattaaaataattattgtattaacatgcatgtattaacatgcattgtattattgcattaacatgttgtgattgttgctattttcttattttgtacactttaatgttgcattttaataagaataaatcaaaatacttttctatgatttaattaaatatgccataagcaggggatagattataatgtttttggaggcccatttagagtttgttgaggttttcctctacagtgaaggatgattaagatttgttacctttattagggtatacaaataaaacacacttttactcctcccaaacaaacagttaatggaagagatttcttgtttcaagatggcacacatcacagttgtggggggtcttttcttttttgttttggtggtaacgaaagggctggggtcaggtcagtcttttgaggtgaggtctggaagtcagccgaatctgaccctcgttaatgtcacattaacgtctgtgttaagcacaccttaacctctgtgtttctgggtggagaagctgtgacgggtggggcacacgggcgtgcctttcggtacgtgagggttaaatgggttctcgcagaaagtaaagccatctggtctgcctgtgccagtgccagaactgaagtgccatgggccaaatcacgctgctgttgtctccctttcagtaacctgtctctggctggattgtggattaactgaaaggctttgatattacattgttctgtcttattgtgttagggtctcttttagcgaatggtgttcaccttcttaatgggggctaaaatagagtcttttattaagcctaattacagtgttctaagtgactggcccaagaaatggcagctggtggtctgaagctctgccctgtgccccttagctaaagagaatattgtgtcctccttttcctcttcaaccctactgagttgaggcaatctctttttttttttttttttttttgagacagagtctcattctgtcacctaggctggagtacagtggcccggtctcggctcactgcaacctccgcctcccggctttgagcgattcccatgcctcggcctcctgagtagcttggattacaggcatgcaccaccatgcccggctaattgttgtatttttagtagagatggggttttaccgtgttggccaggctggtctcgaactcctgaccttaagtggtctgcctgcctcagcctccgaaagtgctgggattacaggcataagccaccgtgcctggccaagttgaggcagtctttaagtcctaagtgtatgtccctggactgctggtaccttatttcctcagggacagagcacctcggtcacagtgtggtcagggttgggcaaggccagcctgccacactgtgccctcagctcatgggcctggggtgttgctgtgtccaggcctcttccacctgagctgttagatactgtccagggaagtgccagagttgtgagtgctctggaagaaatgccaagtgaggagtggcccaaggctttgggcagggagagggagtgtgaagaggcgccgtgcaggtgccccagccatggagttctccctgtgtccttaaggatggctcagaggtgggcttttgtaaagaatgccttctgacagcagaacagaggacctgaattcaattacagaaatcaacacttctaaaaatgcttcttggctgggagtggtggctggcatctgtaatcctgcacttagggaggctgagccaagagatcacttgaggccaggagtttgagaccaacctgggtgaaaaagcaaaaccccatctctacaaaaagccggtgtgggtagcatgcacctgtggtcccaactactccgaaggctgaggcgagaggaccccttgagcccaagaggtcgaggctgcagtgatccatgattgtgccactgcactccagcctgggtgatggagtgagaccctgtctccagaaacataaaaaaaaccaattaaaatgcttgtatgtttgaggctgtatcctgctctggagatgagtgaggtgttgattttggcctatgtaattaagtaaacagacattcgcacaaatcacagggtaaaggtgggggagacgccataaagcgaaccagagcgatgggactcggtggagaggccacatacaggccacgtgtgagtggcccttgaagggtagctagggcaggtggaaatgggagcctttcatgtgagggcactatgttgtgagctctgtggcctttttttgtttgccagccacaggagttggtgctgttatgcccacttcactgatgagggagttgaggttcagagagatcatgggtccagggttttacagcttgtgggagacttggacctaggtctttacctctcaaaagtcccctttcccccagtgctgtaaatagtaagcaaagacaggaaagcaggaaggtattctggcaatgtggaataggcagatggggctgaagcgctggctggaaagatgacctggggccagacgataaagggccttgagtgccctggctttgggcgttattgtgaaaccgtgggcccaaggacactggggatgatggggaacagctgggtgacttcctgacagtcatccaggcctgaaaagtggagctctcttagtctttctgactttcccatctgtttaaaataccacctactcttgcagccctaccgattttataaagaaacacaaagaaaatagagaaataaaatacagttgacccttgaacaacataggggttaaggcaccaacccccagcacagtaaaaaattccgtgtatatccttctgatacaattctattaaaaaaatcttgtattacttttgactctctagaaactaaactactgatagcctactgttgaccaaagccttgctgaacataaacagtcgattaccacgtattttgtgtatgtatttatgtattatattcttacaatcaagtaagctagagaaaagaagatgttattaagaaaataacaaggaagggaaaatgtatttgccattcattaagtgaagtaggttatcatcaaggtcttcatcctcttcatcctcacactgagtaggttgaggaggaggaagaggaggggttggtcttgcagtctcaggggtgctagaggcagaagaaaacccatgtataagtggatccatgcagttcaaacattgttcaagggtcaaccgcacaaagcaataatcactgtcttctgtggttcaggtttacctcctaagcatggctgtcgtcttctgtgtttgtgtgtgtacacacaatgcacaggcgtagctgtgcgtgtgagagcatggcatcacagtaactacgtgtacctgctttttccaccagtgcttatatcaccatgcccctaacttggtgatttttgatggcggccacagctgtgcgcagtttcatcctatggctacttggtagtttatttcacctgtcacatcttaacaattttggtttctttcccacacagatcctgaaattcctgttcaggtcactcaggatattgagcctcatttgggagccttgttcacccaaatgttagaggttgggacgacagaggacttgaggctggtgatgcagtgtattctccagggactggatgtcagtaacatgtggaaagcagatgtgcaggtgggtgccttctccctccttgtgtggcaggctcagaaaccacgtcggctcaaatgggaaaactgatttgagatgtggtgtcacccttaaaactaaacaagttctaactggtagagactctaggcaaagggggaggctgtgagagggagccctggcctgtgggacagcccaggctgcggcatagggaggccttagttttcaaacgggaagtttttcaaataacaaatgtgttgtcttattacgttaaatactaagtgttacacattcacaaaactgatccataaaaaagttaaattctgctcattctttgctgaagacctctcacaccatacttcttgaaacatgtggcctgattgggccatactgccttcatgccagcatttgagaagcacctaggttagcctacccccttcagttctgacagaagtcgctaatacagcctgcatggtgttgcatttgctgagtgcctttgcacagagctcacatgctgggatttgtttctctgaatgcctgtgggcactggactggtcagacatctcttacgcaaggaagaaggccacaggccacagagccaatggttggtggggcagagagtccagccaaggtctctggtctaggcatattctgcctcatgaatggcttattgactcctggtcatatacagcacactggtattgggtactgatttgggcaggagaggaaacaaacctaaatttctgtttggaccagttggtcaggagacttcccggaggaagtgaaactccagctgtgcactgaagaatgcaggggacttgattggggagcagaggtgaggggaagggaggcgtgcaccgtgcaggcagcgtgttgggctgccaggagcaggggatgtgcaagagtgagaagatggacagggagaagtggtgccaggggggcaggccctggtggggagatagcctgtaggtgggcaggagagtgggagtggagatggggctttggggtgtgcctagtcagagggagcagggaagggaagagagtgaaaggcagaagccaggactttggctagggttgtggggtgggctgcacagcattcggggagaaagggacggtgtgaggctgaaataggaactcactgacaatgtgaaatgcctggcactgggtctgtttgttcatataggcaccccgtaaaggtagggctctgcccacatctcatggtttaaaaccttatttttcaaaggggaagtttttcaaattacaaatgtgtggtcttattatgtaaaatactaagtattacatattcacaatactgatatgtataaaagttaaattctggccgggtgcggtggctcatgcctgtaatcccagcactttgggaggccaaggtgggtggattatatgaggtcaggagttcgaaaccacctggccaacatagtgaaaccccgtccctgctaaaaatacaaaaattagctgggcctggtggtgggtggctgtaatcccagccacctgggaggctgaggcaggagaatcgcttgagcccaggaggtggaggttgcagtgagcagagatcatgccattgcactccaagcctgggtgacagagcgagactcggtctcgaaaaaaaaaaaaaagttaaattctgctcactctgtgcttaagacctctcccaccatatattttgaaacatgtgacccgattgggtcatattgccctcatgtcagcatgtagcacccgtgaccacagcacctaatccgattgttttcacattttcctccagcccctcctatctgtaagcgtgcatcgttgctcagtgaagtaacagccagtgtcctctgcgtggacagagccttgacaagacgggctctctgtaattaggtcacagtgtgtgacccttttgcaattcactgtcctggccgatttacgtgcttgatttagtgaaatgctgctgaaagaccctgactttgccccagctctgctcatcttcttcacttccttcctgtctgcatgctgatgtgaagggtgtccctcccaggacttaaccccaagcaggccttgtccacctcccctgacaccagggctctcaatccactccaacgccacagccccagagagcagtcttcttccccaggcggagttcttaagggagaacacgctatctctgccgctaagttttttctctcttgccccaggctgttgtgtcagctgttacactgctgaggctgctactgaactgcccactcagtggagagaaagcaagtctgttgtggcgtgcgtgtccccagatagtcacagctttaacagtgagtaccctctggagatgtgtcctctagctcctcccctccctcttcctgtaaagacagaagtcagccttttggggtctgctgccctgtagctttatgcagaacgtgtgtgtgggctacttccaaagggcggtggtgagcaggatgccgagcttgtgtgtcctgcctgagcacattggtatcaacggttggagcagtggaagggaagtgctaacaagggacatttagtagcactgggaagcatcagacaggcagtaagaagagggatgtagtgataaagggaggctatcgtggaggcctgcttaatttttaaaattttatgttttattatttttttagaaatggagtctcactgtgtggtccaggctaaggtgaagtggctatttgcagttgcaaatgtagtgttctgcagcctcaaactcctggcctcaagtgatccttctgccttagcctcccaagtcaccaggattataggtgcatgccactgcagccagcttgtagatgcctatttaatcagatgataaaagaaggaattctggggctttctttgtccccacaaaatgttgtggttagtttaatgcactcatttatttgtaggagttgtatgtgtgtgtgtgtttaaggcctatgatacagtgagaataaaatgctttacaggatgggatagtaatgttgcagataggagtttattttgttacagtcttactcaaatgttaaaatttgtgtccagttgttgctaggctgtttgtttcactagaacagtctggttcagattgggactgcctcctgccctctaaaaaccctgacctgggtgttcttacacttaggtgcgaaggagcagtatctattttaccatcatactctgccctaattctagctgttgctacctgagacaattgccctgggttagcatgttcctggggcaaaagggtctaaaaaacagacttaatattctctcttgtttccaatttggctgctttgtcattttcctgagcatccgtgttggtggatggcaggggtcatcgtcaccgagcatgtgtggtgagcatcaggagaggcacgtgacccatgctgacgggcagggacagtgttgatgatgcgtgtggtaggccctcactgataagaacactgggctagaatccacttacgtccacccagagggtgtagcaggggtccgcacagccagaatacccagcagaacagtgagcattgtgagagacaggacccaaaaggcctcaccagggctgctgtgtatctgagaaggagggtcacaggtgagctgtcccaggttacttaggtaagactttgagctgtccttcctcttgggtctgttctctttatattctagatcatgaattgaatatctttcactagagctgatctgtaagaagtttagcaaatagtatttaacggcccacggaccacatcaattcattttggagcacagacatttctacctcagtcactcagagctgcagtgtttgtgttatttccttggggaattactttcatttttcctttattttattttgccctttagctcttaaaccgagaagcttctcaggagcagcctgtgtccctcacagtggtcgggcctgtcttagatgtcctggctgcactgctgcggcagggggaggaggccatcggcaacccccaccacgtcagcctggccttcagcatccttctcactgtccctttggaccatctgaagccgctggagtatggaagcgtcttcccgaggctgcacaacgtgctcttctcaatcctgcagtgtcaccctaaggtgagaaggagggtgagagtggcaggcagcttttcctctgcgagcagggtacttgaagtctgtagaaaagtggcagcaaaactttactgttgcaggataataatacaaataacgatttgctaggcaaactttctgttctagtaaatttcagagccaggtggtttctcaagcataaaaatgctcgaccttcatactgggtttgtgagcgagtttttcttcattggatctggtgctatgaatagtgtttgtatactacaggttgaacacttctaatccaaaatgctccaaagctcgaaacttttagagtgctgacatcatgctaccagtggaaaatcccactcctgacctcatgtgactggtcgcagtcaaaacacagtcaaaactttgtttcatgcaaaaaattatttaaaattattgcataaagttaccttcagctatgtgtataaactatataaagtgaaacataaatgaacttttaaattatatttagatgggtcccatctccaagatatctcattgtatatatgcaaatattccgaaatctgaaatctgaaacacttctggtcccaaagctttaggataaggcatacacaatctatactatttaaggaagctcattaaaaattactctgtttttgctcaccacgtctttaaataagccactcgcatagatcccttgctgggcttataattcaaatggatatagggaatgaagcatcctgagttccagttttatagtatgctcctttttaagttaaactgaaactagggataaatgtcccacagaaaaaattacagttcagttaacatttattgaacatttgatgtgttccacccctatagcaagcctgtgaaggaggcagtaatcccattttattgatgagtaaactgaggctcagtgccgccaaataatttgaccagtgtcacttagctgagtctaaaccttagactcaagacttgttatctttgaccagtgttcttttcatggtgccaccactgtatgtgtggctgactatgtatgtaggaactcatagatacgacggttaatgcatcgcttaatgacagagacttgttctgagaaatgtgtcgttaggcatttttgttgtgcaaacaccatagatcgtataatactttcacaaacccagatggtacagagtactgcacacctaggctatggggtatagcctgttgcttctgggctagaaacctacaaacctgtacaacatgtgactaatgaatcctgtagacagttgtaacacaatggtaagtatttgtgcatttaaacagagaaaagttccattaaaaatacaatcttataatcttataggaccactgttgtttatacagtatgcctttgaccagagtattgttttgtagtgcatggctgtgtgtcatatattcatgcacattcagatacttttaagtgttttgatgtcctaaggatagagacctgccagcaatgcagtttttaagaaaaatattctctggtaagctaaacactcatgacattggttctaactctaaagccttcccctgttaacaattgcctttgaccctatttatcttgtcagcatctttgttttaaaatctctctgctgatgttagatttgtatgtaactgtacaatataaatgcaatgcacataaattacaaactgaaattacaggtgcaggatttcatgaagttgatgaaagtaatactagaaagcagcttgattcttctgcaaaaccattagcaaatgaccatttagtggaattagatcatttaacgaatggagaaaattgacaaggataatgacatggtattacagtaaagaatgatgtgaattaatcatagctcactctcatctgttggggttgtgtagggaatctgatggatgatcacagcatcaacagtgtgcatggtaggcccacactgatgtaaacacgcagccagaatcctcttaggtgcatctaaagggtatggtaagaagtcagcacagccagcatacccagcagaatgatcagcagctagtgctgttccaagcactttacatggcttagcttgttcaatcctcatgacaacctatcatcctcattttgcagatgaggaaactgaggtgcacacatacaaagaaaagctagatgatttgttcaagatcataaggagccagagtgtgaacccagatagttccaaaaggatttgtgtgcttttcatcagtatgatagcaaaggattaagagagggtccttggggaactgggtgaaacgctggaatacttttgcaaaaacgacttctttctgaatatgctgcaaaaagtcagtaatttgacatgacgaatgtggtattatgctatcaaaaattttgttggacagattatgccaaagagaataatcccgacacttgacttactctctgttcactctcacacgtgatgcagcactgtccagcagtggtcagcagtggtgggtgtgtgctgtgtctccatcgtccagtatggtcaccactggccacagctgtcttgaccacttgaaatgtggccagtatgactaggaactgaatatttaattttatttaattctaattaatttaaatgtaagtagtcacatgtggctggtggtgctctgctggacagtgtgtggttgtgattcagacctaaagatgattgactataaaagaggcatgttttgtcatcaaaatctcattttcttttttttttgagatggagtctcgctctgtcactcaggctggagtgcagtggtgcgatcttggctcactgtaacctctgtctcctgggttcaagcagtttttgtgccttggcctccccagtagctggaattacaggcatccggcgccatgcttggctaatttttgtatttttagtagaaacagggtttcaccctgttggccaggctggtctccaactcctgacctcagatgatccgcctgcctcggcctcccaaagtgctgggattataggtgggagctgctgcgcccggctgaaatctcatttttcgagatgaagttttcaagcagaccttttcaccactattaattgagaggttttggtccctattttaagtgcatttgcttcaacataatctttttttttttgtaccaatgatacttgaatatattaattagtactgttcctattattgtttgtttctacccatttccagaatggattagcaccagcttagagtaaaaggtacagactcagcaaattccaaaccaggattgccccatagacctcctgaagttacgcagtgtgggttctctaccctagatagttaaaacaagggtcaaagagtctaatacaagatgggtgagcagtgacagcagcatgtccaggcgaaaggatgtggctatccctgggcacacacaactggtttgagtgtcccgatagactaggctaagaaagaaataagtatgagctcctttaaagtagaaaaacttaaataatcacgtatgtacttttacattctgttatctgtcattacaggtaatgctgaaagccatcccttctttcttgaactctttcaatagattggtgttttcagttatgcgggaagggcggcagaaggacaaaggtaatttggagtaacatcagacacagtttcaaatatattcatcatgaggtgtggctgctggccacatatgttactgaaaataaaactactcacttgtgtttaaataagagaaatgatatcaaatgaatactcaaaatatatattttttaaaatttcaaatggtcacattttatcttatccaaaacagtggatgaatcaggcatctccttattgaaatagttccttttctgggaaaaaaaatatcagatttaggaaatgtttactgagcatgtatatcatgtaaaggggatataaaaatgacttacaaccccattcctgcccttaaggagcttatagttcaatagggagatgaaaaggaacaggcaggtatagagcaatctcattttataaaagggataaggtcctgccgctcactgttccagcctcaccttggcaagggtgtgtttgtttactagggaaacactaactgccatatggcaatagcatatattatgtgtacaattcatttttcagctttgaagttgattcttgttgaatttctaatttgagggagacttttattattttaaaaattgctggccgggcgcagtggctcatggctgtaatcccagcaatttgagaggctgaggtgggtggattacctgaggtcaggagttgaagcccagcctggccaacatggtgaaaccctgtctctactaaaaatacaaaaattagctgggcgtgatggtggactcctgtaatccgagctacttgggaggctgaggcaggagaactgcttgagcccgggaggcggaggttgcaatgagctgagatcgcgccattgcactccagcctgggcgatagagcaagactctgtctccaaaaaaaaataaaaaacaaaaaaaaaaattgcatgaatttcgattttattttgcagtattttgaaattgcatagcatgtaccagccctgtactgtctgatgtgctaagcagtaggtcagggtgtcagctcagaggctctgggaccataactcaactcggggtgtcagagaagagcctgtgaccgtagttgtgggccgactggaaatacaggagtggtgctcagcttctctcccaccattgtggttcagttttgtagacctaagcaataggcttttaaccagacatcttttgagaaaaggaaaagggcattgttaagactaggcttcaattcctctgcccggttttgggatcaatcagtggcacagttagatatttcgcttcttcctgtatctggtgcagagcacgtcagcttcatattgtgaatcgatttaggagcagcattagtaaacaagtttcccctcccatgccagcctcagcaagttggtggtggctgcctacagttctgtgtcaaagcctctcccatcatgtctgagctcagcaaggaggaatctctgttcttgtagtcatgtctgcctggacggaaggccggggccttgctcagcagtggtggagcacagcctggtcacactgccacaggcatgtcctttgtcatgtatttgaggaagcacaggagcacatcacacttctgggactctgtgctgtgttcatgtgaaggtagcttcgtcatcatatctgctaagacctggttctcagacacattcatggcttaactgagtagagttttaactattttattatctcttttattggtatctaatatgctctttctaatgagcatgcattaaattggcggccgaaataacaagtgctatgtattcatgttgtaaatagcatgtatatggtgaacagtctgaaaagagaagaaacagtcaatgttagatattaaagcatatcactaaagtatattgtctgttgaaatgctacatgaatgttaacagttgacatcatttcatacaattacattgatctagaaaaattacatctataaaagatgtctgtatgcttattcacggtcttcaaaaaagatatgccttctaaaaatcaaatttattgagttatatacaatgtatgcataacaaattgcttctgtttaaagtataaaatttaatgggttttatgtatatatgaagccgtccccacaatcaaaatatagaatattttccatcatccttaaaagattcctcttgtttctttgcagttttttctccactctggtcccagccccagtcacccatctgctttttgtccttatggatttgtttgtgttttctggagttttataaaaatgtgcctaccattgtgctgaatgacagcagggaaggtgctctggtgtgtgctagaacttccccatgagctgtaactcaagctgtggggacactcatgcaattaggattcttgggaggagtttgttaagaggccctggacggtcctgacaccatatggtaggaaaagaactaggaatcagaagtaaatctaagaagacagtagaatgtctgctaatgataattgagtcctatgtctgtccacctataaaaggcacatacacaaacaatttctgaaatgtaaggaggcaaagacataatttagggtatctcattttttaaatcatatgatgtcggtagatgattttctccacttaagataattttcaatttgttttccatttgcctttattatagaactccatcttggtgttttttttttttttttttttttttaagtaatcctagatttcatcctaaaaatcttgattacttttctggttagactcttaaaaacacccgagcactcttgagttttttaaagtgtccttccctttgttgtgtagataactgtttggacatatctgttctcccttattctgtctgcaaaataagccaattaaagagtctgggaaaacatgtaacacttgagataattttcacccatattaaaagtctaacatagaagagttaaaatgtgctgtttttgaactaattggttgggaaacactttgttgtctgtaggaagcatagatgacctgcctacggtcctaaagtgtgcacgcctggttgaaagaatgtacagccacatcgccgcacgagctgaggagtttgctgtgttttccccatttatggtggcccagtacgtgttggaggtacagaaggtaaaattgggttcaatgtctttcaccaagtactgtgtttatggtccttaagcagggtttctcaaccaaaatggcaagcggtgttctggatctgacagttctctgttgctgtgtgcaagttttagacagggttttgctctctcactcaggctggagtgcattagtgcgatgatagcacactacagcctcgaactcctgggctcaaatgttcctcccgcctcagcctcccaagtagctaggactacaggcatgtactactccactcagctaatttttaaatttttgtagagatggggtctccctatgttgtgcaggctggtctcaaactcctggcctcaggccttcctttctcttcagccttcccattctctggagtcctgtctagttcaaggtgtttagcagcattcctacagggttattgtaaggaccaaatgaaatgacatacagagggctcagtggtgccttgtacacagaaaatgctcgattatctgtcttgctctagcacaaacttcggggtctatttggttagtttcttgagttatataaaaggagaggaaatgttactcaggtccaagaacaggagctctcataggaccaggcttaatggagactagaaagaggagttctagacctcaggattctgggatcccctcagctgcaagagttcatgtatctttactctggcggtgtgtcactcatgtgactcagctgctctcagacactcaaagtcgatgacaaggtggagatacaggtagttgttaaaatagacagattaagaaaaaacatgtttgtccaaattaatctgactttttgattcagtgttctggataattcactattcaacagttatcttttttctttttgagatggagttttgctctttctcccaggctggagtgaagtggtgtgatctcagctcactgcaacctctgccccgtgggttcaagtgattcttctgcctcagccccctgagtagctaggattataggtgcccaccaccacgcccagttaatttttgtatttttagtagagacagggtcttgccatgttggccaggctggtctcaaactcctgacctcaggtaatccacccgccttggcctcccaaagtgccaggattacaggtgtgagccaccgcgcccagccattcaacagttatcttactttggaatgtcattatgctattttcaaaattccacaggatcctgtgtgacccatagtaagttcactacagaactttgtaaatctatgctgtataaatcttggtttaaattgactgtcataggcttgagcaaagtgcggtgtattcttttgactgtcttcttctgtatgtatagatatacatttatattgtgttcaatctctctgtaaaatacccatttcccctttgtaaatcttgtaagaacaatagtaaaatcacaagtaagcttgttagggtagaggtgtcagcatttgtccagggaggctgggttgaatgggcttccttagaaaacctggagctgcatcacttttcatccctgctcctgttttagatacatctagaactactaaataatttctaccccgctggccttgctcacctcggcaggtggcgatgcctgtcctgtgggtggggacatgggggcagcctggccatgtgagtgcacacaccttaccgggtgtggagcccacacctggtaagtgttgtggatcttgagaacaccccttcacgttgtcctttgaccaagatgtgggcttgtagtttggtttcattgcagttatttggcctttttatggaatcttagtatttcccaagcacaccagtcgttaacatgtaagcttttgatgaaagaaaagctggcgttattttctgtcttactgaataataaaatgagacatagtaatatcacttcactaagagccaagaagagaagcagtaatttgaacccttcagtcactaattattattctgaaatttactttatgaaaagcctctggcttcctggcctcattattcatgtctaatttatgctcattagttatattttatttttaatcttgaaagccaaaggctttgggaattagctagggccatagcctcccagaatccactggcaccacagtccatgttctatctttcattttgtttttaaattcagcaatgaagaaaatattccatatgcattagcagcttctactgagagagccataaatctttctagaccagcgtgtttaagtttaattaaataccagatctaatgctaaatagatctcctttgcattttccttgtacttctgcagagttgagtattgctggtgggacctgtcagtagtcagggaagacgacctggtgagatgtgtcagtcaggagaaggggcagctccagaggcccgcttgtcttctttcctccaagcagtaatgagtccccatggaaacatgcagggaaattatggttactttcatctccttttttacctgtagagcaaatttacaatgtccctctacagatgctcctggacttaggagggggctgtgtcccaataaagccatagtatattcaaaatatcattagttgaaatgcattcagtacttgataaacccatcgtaaaagtgaaaaaatcgtaagttgaaccattgttaagtccagatgctccttgacttaatgatgcagttatatctggataaatctgttgttaattcaaaaaatgtcaagttgaaaagtgttaagttgaaccgtcttaagtcaggaaccatctgtatggtgatagcttagaataagtagtttgtgctgctcatcttatctaaggttttaaaagctacttagtgatgttttcatttgttggccagtgatcttagtgttgtagaaattgactcttttcttgttttataaataagttatctgaaacctaaagatttaaagtggttgtgttgtctaaaacctactggccttcttactacccccagagctctttgcaagaggctgtctagctgcattttcactactgagaaactgtgtaagtagttcagagcatgggctctgggctcagactgcctaggttcaagtcttagcgctgccagttattagctgtgtgactttggggaggtcactgaacctcattttttgcctttggaagtggaattatttatttagtaagtgataattaaatgaatgaacaagtatgaataagtagtccacttacaaagccctcaccctgccagtatgatcaaggactttgtgtttttgtctgtttttcgttttgttttgtttttttctttccctcccaattaccttgctgtaaaattcacagacacgccattctaccttcggtccttgagtgttgctatcatctataaaatggtaaaatttaagatgatcacttgtcagaaatttctgaactattacatgaaaaggatcataactttgaagagtagcatcgtctgagagacagaaacaaattgcctctttaggaatgtacttcccagtggttgccttcgtgaatcagttcttctggttaataaaatatgtcctcattagaaactgtgtttgcagagacacattaaccctttcaggttatcagggtagcaataaatgatcagccaaattccaggcctgtctgctgatgctctaccactgctttggtttttttctacttcttaaaagtaatggcaaaatacatctagtataaggtgaattttaccagcttaactgttttatgtgtgcacttcagtagtagtatatacattcttatattgtgcagccatcaccaccatctgttcccagaactgttcattactactgctttttagtttcagttactagggtttcaaactctgttcagcccacatttagttgaaacctgaatggatgtggtaagtgtgaagagaacctgttcccccagccttttaggttggtttgatattagtctgagtctcttctctggaagtttgggtggagcatcagatacagccaggttggagctggctgccacccacactcctgtgctccagattttaggtaaccctgaacttcaggggagaagtgcatctttagggatgaggaccagttcaaccattccagggctgttaggaattaagtgcatattgtgctgttcttgacataaataaaaaaggaatctattaaatggcaatcatgaaatcacttctgctcttgggtgatatgatgtgatctaattactagtgtaggcttatcagtggtctgttttggtagtttcagagcctgcctgctgccttgctctggggtgagatgggggtcatagtgttatggtgaacgtagttgtcattgtcccacagggttggcatagcttccaaggtgattgacggtgtagaagaatttgacacaatgggcaggcagcttatcttcttataaggtttttaaatttaaagactccagttttttaaaatgcccctggtaaacatgtaagcatcatttactgaacagcaaagccagccttttgctttcatggagttttattccaggtttgtgtttgcttgagttagcttctatttccccaaaatacaaactttaaaaatatgagtatttaaaggtttgacttagtaataaaattatattttaaaagtgaatgtcgatttttttctcaatttggaggtcagtttgaaattacttgttagtgcttcccaaggcattgttggcaggtggtgcggcttgatctctgcccccaattgttctcacagaggtttgcctttttcctcaggtgaccttatatccagctgtgaaaagtctgctgcaggagggcatttacctcatcctggacctctgcatcgagcctgacgtccagttcctgcgggcctcgctgcagccgggaatgagagacatctttaaggagctctataatgactatctcaagtaccacaaggccaaacatgaaggagagaaaagatatacggcctaaggctatgggacagaagtgccgccagtgacactgtccagaggctttggctgcatggtctgaaagagctggagaatgaaagacttaagatgttctaattcgtagtattggtatacatagaaaatcctttggggtttatgtagtatattttgatgtattttacatcgtgtttttcttactattttttaatacatagttttatgcagtaagtattgcaatagaatcctgaaaattgaccctgggatgagattaattcaatagaaaaattgctgactcttgggacctttctgtgtttggttctcgtcttggctcagtggtttggtgttccctcgtctgcactggaaactacataaaacttggctttttactttgggtacatgggcgtataattcagccctgtttaaatatacttgcctttcaaattcttcaagtaacatgggaagtattcttgaaatgtcacattttctgccttccctctaagtatgctttctgaagaagtcagggaaagttagagtctgtggcctgaggtgtctgctctgggtggcgatagtgggcacctcaggcaggtcggtgacgtttagcacaggtgccagggctcctgcctgctcctcctgtgttagctctgtgaagttcatttaggaatttttttttcctatgcagtttaagaaataatcctaattgttttttcttattacctaagcaatatatttttattatagcaacctcagaaaagaaaaataaaaggataatttaaaaaactcattcatagtctcagttacccagataacctcggttgtcaccttggagtatcttgttgtagtccctttactatgtgtatgtatatagatgtgcatataaatatatatagtagctaaattggatcataaatgcatttttttaaagttaccttttttcctgtgtaatattttaagtaactctgggtcagtgaaaacattcgacatatattttttttggctgcatagtagtccattgagtagatattgttgttttatttaataagtacaccatggttagacataggtatctgtccaaattcccttttatagatggtgcttgcagctgaattattttcagaagatgaattctcatgagttgtattatttgtcagaaaaccacatcatttttaaaggatttatataaatattgccaaattgccccctagaatattactaatttattttcctactagtgagtcaactttaatattattgatttttgtttctttatgcttccttgataggagagagatgttattctgttttgaatttctttaattactaagagattatacatttttcacatttaccatttttatttcttatgtaaattatgtttatataattatctttcttctgtaatagcacatttctcaattgggatatttaccatttttcttattcactgtctttgggggaatcatgttggaattccctttttaattagttcaaaatgcagacttttgaagttatttgaaggatcatccttaagcaaaggctttttttttttaacactgtattttcaagcagatgtgattggagcagacaatataaaatgaatgtctttgatacctaagagaaatggcccttgttttacg

SEQ ID NO: 14995 - DNA, 1459 bp, Homo sapiens
gtgaggtttcaccatgttggccaggatggtttgatctcctgaccttgtgatccaccctcctcggcctcctaaagtgctgggattacaggcgtgagccactgcgcctagcctcttgtggctctaatttattatgtagtactctgtggtctgtatattaatgtcttgcctttatcttttatattatatggtaaaaccctgatttttgtattttgaattttcttgtttaattgtacacatttttgtactggtatatcaatagctaatggcctctccccagaccaatgaaattggcatctttttagggggagagggttagattgggtctcaggctctggaattttttaaaaagctcaccagatagtgctggtgtccagctagaattttctttttggattccacactaaaagcttaggccataaaagcaaaaataaataaatggaatgacgtcaaactgaaaagcttcttcaaaacaaaggaaacaatcaacaaaatgtaacaacctatggtctgggaaaacatatttgcaaaccatttatctgataagggattaatatctaaaattcatgaagaactcatataattcaataatagaaaaataatctgattagaaaatgggcaaaagacttgaacagatgttttttcaaagaagacataaggatggctgacaggtatatgaaaaggtactcaacagcattagccatgcagaaatgcagatcaaaaccactgtgggcgtcacctcacaccccttagggtggctgtcataaaaaagtgaagtgataacaaatgttggcgagggtgtggagaaaatggaccccttgtacactgttggtgggagtgtggattggtacagccatgatggaaaatagtatggaggttgctaaagaaatgaaaaatagaagtactatatgacccagcaattccttatcgggcatatacctaaaggaagtgagatcaccttataaagatatctgcactcccatgttcattgcagtgttatttacattagccaagctgtggaaacaacctgaatgtccactgatagatgaatggataaagaacatgtgatatgcatatataatggaatattattcagccttaaaatgcagatactgccatttgccacaacatggatgacctggaggcagtatgctgagtgaaataagccagacacaggaagacaaatattgcatgatctcatatgtggaatcttaaaaaaaataaaaaaaaagagtcaaatatacagagtgaataaaagagtgggttaccaggagcaagtgggtggggaatgggaaatgtaggtgaggggtaagaaaatagcaagtatgtaggatgaaagagcctagagatctaatgtgtaacatgtagctaataagaggactgtagctaataaaattgtactatatttggaattcctgctaaatgaatagatttttagctgtccttgccacaaaaacaaacc

SEQ ID NO: 14996 - DNA, 1239 bp, Homo sapiens
gggggagtaattcttagtcccatgttagaaagggggacgtgggacagaacaactgttcacacgtgaaatctagtgattggccaggctccgtgctaggtcttacattatcatttaattccagtactgtcctgagaactaagcattaggagaagcagcatggggctcaacagtgaagtgacttgttccaggcgggtcctcaggagtggctgtgcagccccagtcacttttcatcacaccggagagggacgcacaaccccagtcctgtttagttgcagatataccgagaagggagagcccacaccgaccttaagggcacttgggccctgaatcctatgcctctcgttccactgcttctcagttgccctcctacctggctggccaggtttggagtctctctcccctgctctggcattccagtcttggcctgaagcacgctatgcctctcatacagtctgccttttctagggtccaagcagcatcccaagttctgttgagatgcagcttgcagtccaggaggacaacggtcacccccatcttcccatgtttttcttgctttaagccctcccctaagctttcacatataatcaccaggggttcagaaattgtcagccagttctccttatgctttaagtagattttcttggggccagatgtcttgaaaaacgctctcctgactcagcagttcctggaatttttggcctatcatttatctcactgttctgagtttacttgtaagcctcttcgcttaatgtttgaatcaagatgagcagtaataacagcttcttgtgtaccaattactcagaactcacttaaattgccttaacactttttaaatgttcttacacatttgaaattctttagggagggatttccagaactttcctaaatttctccacccatggcatgacagtacttagaggggcaagaagttcaattttagaataagctcttctgggcgcgatggctcatgcctgtaatcctagcactctgggaggccaaggcgggtagaatgcttgagcccaggagtttgagactagcctgcaatatgcgaaaccctgtctccacaaaaagccagacatagtggtgcatgcctgcagtcccagctacttgggggcgctgagttgtgaggatcacctgagcccaggaggcagaggctatagtgagccatgatcgtgccactgcactccagcctgggtgacagagtgagacgctgtcgtctcaaaaaaaaaaaaaaaaaaa

SEQ ID NO: 14997 - DNA, 2719 bp, Homo sapiens
ctgcccctgtgggccgcacctccaggacctgttcaccggccaccggttctcccggcctgtgcgccagggctccgtggacctgagagcgactgctcacagaccgtgtccccagacaccctgtgctctagtctgtgcagcctggaggatgggttgttgggctccccggcccggctggcctcccagctgctgggcgatgagctgcttctcgccaaactgccccccagccgggaaagtgccttccgcagcctgggcccactggaggcccaggactcactctacaactcgcccctcacagagtcctgcctttcccccgcggaggaggagccagccccctgcaaggactgccagccactctgcccaccactaacgggcagctgggaacggcagcggcaagcctctgacctggcctcttctggggtggtgtccttagatgaggatgaggcagagccagaggaacagtgacccacatcatgcctggcagtggcatgcatcccccggctgctgtcaggggcagagcctctgtgcccaagtgtgggctcaaggctcccagcagagctccacagcctagagggctcctgggagcgctcgcttctccgttgtgttttttgcatgaaagtttttggagaggaggcaggggctgggctgggggcgcatgtcctgcccctatttcccggggcttgccgggggttgcccggggcttttggggcatggctacagctgtggcagacagtgatgttcatgttcttaaaatgccacacacatatttcctcctcggataatgtgaaccatttaagggggttgttactgggctgtgtgagggtggggtgggaggggcccagcaaccccccaccctccccatgcctctctcttctctgcttttcttctcacttccgagtccatgtgcagtgcttgatagaatcacccccacctggaggggctggctcctgccctcccggagcctatgggttgagccgtccctcaagggcccctgcccagctgggctcgtgctgtgcttcattcacctctccatcgtctctaaatcttcctcttttttcctaaagacagaaggtttttggtctgttttttcagtcggatcttctcttctctgggaggctttggaatgatgaaagcatgtaccctccacccttttcctggccccctaatggggcctgggccctttcccaacccctcctaggatgtgcgggcagtgtgctggcgcctcacagccagccgggctgcccattcacgcagagctctctgagcgggaggtggaagaaaggatggctctggttgccacagagctgggacttcatgttcttctagagagggccacaagagggccacaggggtggccgggagttgtcagctgatgcctgctgagaggcaggaattgtgccagtgagtgacagtcatgagggagtgtctcttcttggggaggaaagaaggtagagcctttctgtctgaatgaaaggccaaggctacagtacagggccccaccccagccagggtgttaatgcccacgtagtggaggcctctggcagatcctgcattccaaggtcactggactgtacgtttttatggttgtgggaagggtgggtggctttagaattaagggccttgtaggctttggcaggtaagagggcccaaggtaagaacgagagccaacgggcacaagcattctatatataagtggctcattaggtgtttattttgttctatttaagaatttgttttattaaattaatataaaaatctttgtaaatctctatatacatctggtcattggaggttccagttataaacccatcttagttccacccctttcccctcaaagggggagcaggggtcaagtgaccccaacccatcctgccagggcagggcctatcttcctgcctctggaagacttgttgcaggtgggtagtgggtcagattccaggtaggatgaactgggagaagctggcaccccaggtctggagggggctggggtgcagcctccagctgtagctgcctcctgccttccgaaggcagaaggaatgaaagatgcacattctgggctgacgggcatggctagcaccatcctaggccacccacgaggggctcattggcatttgtcgtcgctgtcggaagggctgccctcccgggggaggccatgacgggagtggggcccccagagtgcatgcacctcagtggtctccgtgtcactgctgctggtggcactgtctcggaagctggcgaggggcggccggactttcacaccctgtgctgtgacagagccctcgatggccttccggagctggaaaggtgagagggacagatgtctggacccagatgtcagactcctccccgccttcctccccaggtgagctggacataagcctccatgactttttggaagtggagcagctttggaggccaccatcacctcacctcctttagagtaacgattccaatgagtctgccaatactggtgacataagcatggtccactcccagcagtgagaagatagtgtgagtctgcagtgtggggagaaaagcgattggacttgatggacgaggggcagctctaaatgacaggccacaggggcccaggacaaggttggtgtggaataggaggggtgccccagattgggagggaaggagacaggactgctggagggaaaataataacaatcgtaataataatgagaatgtttctgtgtccaggcctcaggaacttgat

SEQ ID NO: 14998 - DNA, 224 bp, Homo sapiens
agatcgagaccatcctggctaacatgggaaaccccgtctctactaaaaatacaaaaaattagccgggcgtggtggcgggccgcctgtagtcctagctactccagaggctgaggcaggagaatggtgtgaacccaggaggcggagcttgcagtgagccgaggtcgcgccactgcactccagcctgggcgacagagcaagactccatctcaaaaaaaaaaaaaaaa

SEQ ID NO: 14999 - DNA, 4127 bp, Homo sapiens
cagagcgacctgcgggttgggctgagtctgtccttgaggaagatgcatcggagcttgagcctgccttctccaggtaaccttctccagttctcttctgttttcaatccagcccttgcctaggtgtaagagagagattcccattggttgtcctgaggttgacttgggggagcactttttgataagctctttttcccctaatatctgctaaacttatagagggttatgtaggtatgcagaagccagaggtgacccacccatgttactgcaggtgaaaaggctatgtactctttcctcagagggtaaagcctcacagaagaggcctgggccccagacaggggtacattggggatactttaccaggtaacaagcagatagtgggggattaggagtgttagggagtctcagtacaaatgtgtgtttctaggctaattttagctaagactgccagccccttcttagcatggggaggaattggctgagattgagtcatctgagatcatccttttaaaaaatcttcataaaacccatagaaaaagtgatctagggaaaatttagtaatttttgttaactaatgtttcccccttcatccctgtaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactggtaagcctgatggatcctgggttcctccacccccaggtccctgggaacagctaatggtaggtcaggcatttggtagcatgtcttcagctgctgggatttaaccagcaaaggagcagatttcatacctcccttgcactggtcatccttatcattctccccataggccacttgcctgccttgtctctttttacccttgcagcattaaagagaggagggtaggacagtcactcccaatccccattttagaggtaaaaatagagatctaggaattggttgagtttgtttaatgacagccactgaatgagggacttggttaggtaagagaccttattttctgtctcctctccccataccagtgggcacagtatagcaatctcccagccccatgcctgtattgtgtaaagaatgtttctttttggccaggcatgtgtattactgttatggccaggcacgtgtattactggttcacaccggtaatcccagcactctgggaggccgaggtgggtagatcacttgaggttaggagtgagaccagcctggccacatgatgaaaccccgtctctactaaaaatacaaaaaattagccgggtgtggtgacggtgtctgtaatcccagctgcttgggaggctgaggcaggagaatcgcttgaactcgggaggcagaggttacagtgagccgagatcgtgccactgcactccagcctgggcaacaagcgtaaaactccgtcttaaaaaaaaaaaaaaaaaaaattagccaggcatggtggcgggtacctataatcccagctactcaggaggctgaggcaggagaatcgcttgaacccgggggtcagaggttgcagtgagctgagattgcgccactgcactccagcctggacaacgaagtaagactccatctaaaaaaaaaaaaaaaaaaatcagattttatatagaaaagctggatctctagcttctcttggaaaatcaaaagatcttataatggtgggctctccagcttgccccagttccccggaactcacctgtctttattcgttgatgatattatggagtatctctgagaaaatggggcctcctcagccagatgctgcaagaggaggtgaggggcagtgggcagccaaggggatgcagcctgcagaaggcgttcccaaaggactctgccactgcctgcccatgcagtgtggctgcggctgcttttacccattggcttctgctttgtgccccagatcacaggctgtatcgagatggaactctcaagctcctgggtcgtctctcccttctctctgaagagatactctgggctgccaatggcttacccaaccccttctgctcttcagaccacctctgcctgctagccagcttcgggatggaagtcaccgccccatgacagggctcccaggggaagagagcttctcttccagaagagctcactggatcagagactgtggaaaaatcccatgcatctagaaacttagatccaagaaacttacatcccctcccttccccctcctcgttccctttttcccacggttagactttctccaggcctggctgcgttctctgcctgtggtccttgccccaccccagcctcttcctaatcctgtgccacacactcagtggccctgggagaggcagaaggggggctcccccttccttccatgtatccagcgctcccccttgatttttaattaccagggttatgggagttcttgatttcattggttatttgctttcaggccgtttcttgatgtaccttctgacctgaccttttccctgccttcaggacttctgggcccagccctcttgccaggcatgcatatgtgagatatgcatatcatgtatgtgtcctcttggggtgagacttctgcacagccatgcctgcctctgaccagtccacttttcatgttggggctgtaggcctggggcaggttcagagtctacccaagtacctatgtatgagcaggcagcagcagggcatggccccatctctccttttagcctctgtgtttcattaggcattcatcctgccaaccagggcaggcccggcgtctgggctctgggaacaaatggggcccacatcctggagtggcaaattttgggggatgcgctacctgtcccagctggccctgtgcctccaacccagagctccccacagacctggtgtaatttcacaagggccatccctttccccaggcttccctgagggaggcggaagtttgaacccttatgtggggttcattgggctagggtagtggtatgaggtttaaaactatttaaggattaggaggagaaagagtcttcaggaaactcttgtttcactggactctgcagcctgcagaactggggcaagggtaggagttccagtaggggaaggagcaggtagactcttcagctgcctcagctgggactgaagacctaagctgattctctttcctctccactcctaagaagcaattttctgttcctctccttccaccactttttactttctgctatctcccatctcccgcttcccttccatttcctttctagaaaaccctggtatttagctcaggccaaactgcctcagcagaaaggtggccttggacaaaactggtccaagaatttgaagtggcagtacttgcggattggctctgtccagcaaggcctcagctgcttgttgcgtctgctttccctcccctaacagaagggtaccctggcttattcaggggactccttagtccacactgtgtcacctgcatgccttaatctttcattgctggggtgtggccttgggagatcctgggccagcccctccacacatctccctaagtcagagtggctgctggccctggtagatttgacttgctcttgcctcactcgacctccaaagtgggactgaagacagtggtcaagagacttgagttcgggacagtaagccaggggttaaggttctttcctttttttgaaagccaaagacccagtttgcattgtgctgctgcattcatggttagaagctttccatgcctaggttctagggaatttatttttctatgtgtatatattttcaaactttgtttcctgggtactgggcatgtgcctgtctgagccccaggtctgtctacaccccaccattcattctgtctgtctgttccctggacactgcctaaaagggtctcaagacagtgccctgtgggttcctaggactagggcccatcactgttctcttctgctgggaaatgcagctttaaaatggctaaccacagcagagggcagatgcttgatagattatcttttccttgctttcttgtttctgttttgaaagtgaaatggggttttaaattgttatttaaactctttttccaaataaaggtttaccttttttccccccaa

SEQ ID NO: 15000 - DNA, 973 bp, Homo sapiens; identical to SEQ ID NO: 10511

SEQ ID NO: 15001 - DNA, 3386 bp, Homo sapiens
  misc_feature (1321)..(1321): n equals a,t,g, or c
  misc_feature (1653)..(1653): n equals a,t,g, or c
aggaagggctgcactttggcgtagagtacataggcatgcaacatgggagggcaggccttatgaaatgtatatacagaccccttggggtgaggggccccggccaggaggcactgagcaagggaggggtccatctcccgcctggccgggagtggggctctggggcaatctctaagggttgcatatccccaaggagaggggacagctgccactcctgcctctgttatcccaacccaaaccggagagggtgctcagcaagaacacaggtcccataagccaagaaggtgttggcatccctgtcattgaattcaggggtccaagaactgtttgcataaaatatcattagacctaagagatggtcaaaggcacaaagtttaaacatggggggggcgggtgttgagaggggtctgggataccctgaagcccagaggtgtgatttgttcccccttgcccagaagggtgactgttccactgggcctgtcaccacaggacattttccatgacaagcactcaccttcttggggaaggggcatcaggttggcacaggaaaggcccaggtgaggggccactctgtacattaatactttggtgattaatgtttggggagaggcaggattctcacccaggcttttgactcaaaccctctcactcagctggatatgaaacccagagtccatgctactcccagctctgacacaaggccaagcccacagaacactcccaaacgaggtcccgagagttagggaatagggtggaaaggattggagggcatcttctggaagagagcgctagggcagatcacagtttccgctccacaggttgctgtagacacagttcgctgcccgcagagatgatgggcaagtgattgtccatgtggtagctgataaggtgactgacactttcaaagcggtgatccttagtccgaacctgggagggtgggaaggaagaaggtcaattcaggtgaagagtcaaataagacctcagcctccaaggtggaagagggtgaaacagacaagaggcttgaaggcaggagaaaaaaatggtgggggagagtgtggcctgtcaatcctgatcattgaggcttctctagaaagagacagttgtaggaatagacaggtcagtgaagtgagaaaaggcaaaggcgacatcagccctgaaagagtgaagctgagagctatatacccctttcttgacctggaggaagttggcatgtctcacaagagtatacacagtgcaaaaaaagatgtggaggctgggcatggtgggtcctgtgcctgtaatcccagcactctgggaggccgagggaggcggatcacttaccccnggtagatcaagagcagcttgggcaacatggcgaaaccccatctctaccaaaaaaaaaatacaaaaattaaccaggtgtgccaccacaccgcagcctgagtgacaaagcaaaaccctatctcaaaaagaaagaaaggaagctgagattactgtatacaacagacactagtttttttgtttccagacagggtctctgtcacccatgctaaagtacatgggcgccatcttgctcactgtaacctccactcctgtgctaacgatctcacgctcagcctctgggtaggtaggactacaggcatgtgtcaccattcctgactagagacaaggtctcgntatgttgcccagctggtcttgaactcctggcctcaagcaatcctcccacctcagcttcgcaaaatgttgggattacaggcatgaaccaccacacctggctaaacaaggaaagttttgaagaacagtgaggcagtgcagataagagaaagcacagtggtctgagtcctgagtctggggagctggagaagcccttggatcttcttacaaaaggaaacttgcagtgtctagcctctaaccatctgacattgggcatcacaacctcttcagggtggtttccttatttgtcaaaagaggggcacagatgagatgactgccttctagctctgataagcttaaggcttggggatttgaggacgggccaggactgtatttgttttgttttgttttttcagacagagtctcactctgtcacccaggctggagtgcagtggtgtgatctcagctcattgcaacctctgcatcccagattcaagcaattctcctgcctcagcctcctgagtagctgggactacaggtgcctgccaccacacccggctaatttttgtatttttagtagagacagggtttcaccatattggtcaggctggtctcgaactcctgacctcaggtgattcacctgcctcagcctcccaaagcgctgggattacaggtgtgagccaccacgcctggccctgtgccaggactataaagaacatagttcacgctaagggatgagcctctggtatgaagatgccagacactttaaagagcaagagaggcccatagacagctgcccagcgggaatgtctacaaagcaatgagggaaggaagagggatacactgtagggtactgtaccttcctttttgccacccctcacccacacatttgccacactcaccacaccctcagggtccaccagtagcaaatgcttaggctgcccactctgcaagccagtgagcacatactggccaggtgtggtcgtgctctcccgtaccaggaagtccccattgaactgcagcagtgcctcagcctcccgccggctcagcttcccatggaaccagggctcccctcggagctgctaaaccatagacaccctactggggacgtggaggcacgcgcaagagcatcttcgaagggctctggaagtatagagggagggtgaggggaagtagcaggcacaacacacacccaagacccagacttcagggaagggaagtcaggaaggaaagagcagataggcaggagaagggccagaaccaagtagaaaggtggggatgcagagaggagagagacgagcactcactcatgtcaaacaggtcccggggtgcactgccattgatagcaggattggggggcccagcaccacccactgcttgccgggccttgtctaggttctggacgttgacataggagggatcatcaaaaagctctctgcctgctgaggaaagggaggctctacagtgatcccagccctgcctccaacactccccagctctgcctatctcggctcccttcatacctggacagggtggtggaggtggcatctgtttgcggacttctggatctcccccaacaggctgtcctacaggctgcagggataaaaataaggtgagaccagaagccctaaccaaccactcccaccctagccccagcccgcctccatccaagcaacttaccaatgtagctcccaagtggctgggggtctgggcattgggtgcagtgggtcgagcagccctggagcggcgtcttcccg

SEQ ID NO: 15002 - DNA, 3321 bp, Homo sapiens
cctgagtatttgacttccttcgcttcttttctggactcttcatttgcagacctggaagagcggcaaaaggaagacgcagacaagtttccctgaggtttccccaacctcttttctctcagccatgctctgaggaactcctttaacgtcaatacatacttgcttatttattcaacaaatgctaacaaggggtgcaatatgaaaaatagattgtgaagatgatcatactctcagctacgtcttcctttaaatgaaagatatcccatctttcgatatcctcaagctccaagtgagtactgaattccatgtggctccaaaccctagagtcctcaatgtgtgacacctgcccccaacccctggaggattacacccacccatccttttcacctgagcctcccttcaagccttcagactgtgaaacaccccccgcccaccatccctcccctctgaggttcccaagtcctgggcctcttcagcccccgcccctcgcagcgcgctcaccggccttgccctgcttcctcccggtgctgggcggcgcagggggcggtgcggggccgccacctccctccagcttgtccggtgggggcggcgccgaggcggccatggagtgggggacccgggttagcggcagcggcgggggatggaggcgcccttgggctgcaccatcgcccagaaggggtgtcaggggcagcccaggcccccgagctgcagcaaccacaaagtgcgacgacagggaagcgccgagccgccgcgcaaactgcgcgctctctccagactcgccgcccgccagcggcggcagcaaccggaaccggaactcgtcgcggccaccaccactgagcgctgcggggagggggagcaaggaccggacgagacgctacgcctgaaaacaggcggcgggcgagggacgaggcttaccacggcaccacgcgagtggaaagggtcgtctccgctagcggcggcccacaccagctcaccgaggggcggcagcgcgcggcccggctgccggaccgtaccatcccgggcggtggagccgccgcggaggggcgcgcgcgagccgaaggcgcacccgggaggcccaggtagcccgggggccggtgctggggcgccgggcaggcccggctcccgcctcgacccacccggagccagccccctctgcggacacgacatccccatggggacggtggcgcgaaacgccccactctgccgcacccaaactctgcagacccccagcttccctgggcggccgcgacctcccgcctccccgtctgccgctgagggcccgcggcgtacacaataggcttcccagaagggttaagaggcagaggtagaagaaatacggactttaatgaagagttttccctttggtataagtgagacccgtggaaacatccaaacagcaaaaggaggccaggatgaaaacggtcaactctcccttatccacaaggccaaaagagggggggccggcttgctgtggtgtggccaccccgggcctaggctgggccgggcctgtagaaggtactcaggaactgcaggttttgcgtttcccctccatgaaactgacaggcattcgggctgacttctgcctctcagtctcgcggtaagagacccaagtttttctagtcctagatggaaataaatttcatctgcctcaggtctctggtataaaaggtgcgatcccagttacctcacaggcctaggcgaggaaaatgccaagagctgtaaaagggcttggaaaagtcaaaaaggtgatgtataaatgtaataattgattatcattttgtgctcaagaataagcaatggaaaagaaaataggaaagtaagtctacagccctaaaatatatgcatataaaactttaaaagaatgcagttccaactctacagatggtatgtggggattgtctactgctttatagtctcaatgccccttttctcacctccacaaaatccacctgggagagttaactgtacaagaggcccaaattcagtcacccccaccccgccctcccagaaagggaggcagggcagaggcttcaggaggaagggctgcactttggcgtagagtacataggcatgcaacatgggagggcaggccttatgaaatgtatatacagaccccttggggtgaggggccccggccaggaggcactgagcaagggaggggtccatctcccgcctggccgggagtggggctctggggcaatctctaagggttgcatatccccagggagaggggacagctgccactcctgcctctgttatcccaacccaaaccggagagggtgctcagcaagaacacaggtcccagaagccaagaaggtgttggcatccctgtcattgaattcaggggtccaagaactgtttgcataaaatatcattagacctaagagatggtcaaaggcacaaagtttaaacatggggggggcgggtgttgagaggggtctgggataccctgaagcccagaggtgtgatttgttcccccttgcccagaagggtgactgttccactgggcctgtcaccacaggacattttccatgacaagcactcaccttcttggggaaggggcatcaggttggcacaggaaaggcccaggtgaggggccactctgtacattaatactttggtgattaatgtttggggagaggcaggattctcacccaggcttttgactcaaaccctctcactcagctggatatgaaacccagagtccatgctactcccagctctgacacaaggccaagcccacagaacactcccaaacgaggtcccgagagttagggaatagggtggaaaggattggagggcatcttctggaagagagcgctagggcagatcacagtttccgctccacaggttgctgtagacacagttcgctgcccgcagagatgatgggcaagtgcattgtccatgtggtagctgataaggtgactgacactttcaaagcggtgatccttagtccgaacctgggagggtgggaaggaagaaggtcaattcaggtgaagagtcaaataagacctcagcctccaaggtggaagagggtgaaacagacaagaggcttgaaggaggagaaaaaaatggtgggggagagtgtggcctgtcaatcctgatcattgaggcttctctagaaagagacagttgtaggaatagacaggtcagtgaagtgagaaaaggcaaaggcgacatcagccctgaaagagtgaagctgagagctatatacccctttcttgacctggaggaagttggcatgtctcagaagagtatacacagtgcaaaaaaagatgtggaggctgggcatggtggtccgtgcctgtaatcccagcactctgg

SEQ ID NO: 15003 - DNA, 12493 bp, Homo sapiens
cggcccacaccagctcaccgaggggcggcagcgcgcggcccggctgccggaccgtaccatcccgggcggtggagccgccgaggaggggcgcgcgcgaccgaaggcgcacccgggaggcccaggtagcccgggggccggtgctggggcgccggcaggccgttcccgcctcgacccacccggagccagccccctctgcggacacgacatcccatggggacggtggcgcgaaacgccccactctgccgcacccaaactctgcagacccccagcttccctgggcggccgcgacctcccgcctccccgtctgccgctgagggcccgcggcgtacacaataggcttcccagaagggttaagaggcagaggtagaagaaatacggactttaatgaagagttttccctttggtataagtgagacccgtggaaacatccaaacagcaaaaggaggccaggatgaaaacggtcaactctcccttatccacaaggccaaaagagggggggccggcttgctgtggtgtgccaccccgggcctaggctggccgggcctgtagaaggtactcaggaactgcaggttttgcgtttcccctccatgaaactgacaggcattcgggctgacttctgcctctcagtctcgcggtaagagacccaagtttttctagtcctagatggaaataaatttcatctgcctcaggtctctggtataaaaggtgcgatcccagttacctcacaggcctaggcgaggaaaatgccaagagctgtaaaagggcttggaaaagtcaaaaaggtgatgtataaatgtaataattgattatcattttgtgctcaagaataagcaatggaaaagaaaataggaaagtaagtctacagccctaaaatatatgcatataaaactttaaaagaatgcagttccaactctacagatggtatgtggggattgtctactgctttatagtctcaatgccccttttctcacctccacaaaatccacctgggagagttaactgtacaagaggcccaaattcagtcacccccaccccgccctcccagaaagggaggcagggcagaggcttcaggaggaagggctgcactttggcgtagagtacataggcatgcaacatgggagggcaggccttatgaaatgtatatacagaccccttggggtgaggggccccggccaggaggcactgagcaagggaggggtccatctcccgcctggccgggagtggggctctggggcaatctctaagggttgcatatccccagggagaggggacagctgccactcctgcctctgttatcccaacccaaaccggagagggtgctcagcaagaacacaggtcccagaagccaagaaggtgttggcatccctgtcattgaattcaggggtccaagaactgtttgcataaaatatcattagacctaagagatggtcaaaggcacaaagtttaaacatggggggggcgggtgttgagaggggtctgggataccctgaagcccagaggtgtgatttgttcccccttgcccagaagggtgactgttccactgggcctgtcaccacaggacattttccatgacaagcactcaccttcttggggaaggggcatcaggttggcacaggaaaggcccaggtgaggggccactctgtacattaatactttggtgattaatgtttggggagaggcaggattctcacccaggcttttgactcaaaccctctcactcagctggatatgaaacccagagtccatgctactcccagctctgacacaaggccaagcccacagaacactcccaaacgaggtcccgagagttagggaatagggtggaaaggattggagggcatcttctggaagagagcgctagggcagatcacagtttccgctccacaggttgctgtagacacagttcgctgcccgcagagatgatgggcaagtgattgtccatgtggtagctgataaggtgactgacactttcaaagcggtgatccttagtccgaacctgggagggtgggaaggaagaaggtcaattcaggtgaagagtcaaataagacctcagcctccaaggtggaagagggtgaaacagacaagaggcttgaaggaggagaaaaaaatggtgggggagagtgtggcctgtcaatcctgatcattgaggcttctctagaaagagacagttgtaggaatagacaggtcagtgaagtgagaaaaggcaaaggcgacatcagccctgaaagagtgaagctgagagctatatacccctttcttgacctggaggaagttggcatgtctcagaagagtatacacagtgcaaaaaaagatgtggaggctgggcatggtggtccgtgcctgtaatcccagcactctgggaggccgagggaggcggatcacttgagcccgggagttcaagaacagcttgggcaacatggcgaaaccccatctctaccaaaaaaaaaatacaaaaattagccaggtgtgccaccacaccgcagcctgagtgacaaagcaaaaccctatctcaaaaaaaaagaaaggaagctgagattactgtagaaaacaaacaaaagtttttttgtttccagacagggtctctgtcacccaggctagagtacagtggcgcaatcatggctcactgtaacctcgaactcctgggctcaagcgatcctcaggcctcagcctcctgggtaggtaggactacaggcatgtgtcaccattcctgactagagacaaggtctcgctatgttgcccaggctggtcttgaactcctggcctcaagcaatcctcccacctcagcttcgcaaaatgttgggattacaggcatgaaccaccacacctggctaaacaaggaaagttttgaagaacagtgaggcagtgcagataagagaaagcacagtggtctgagtcctgagtctggggagctggagaagcccttggatcttcttacaaaaggaaacttgcagtgtctagcctctaaccatctgacattgggcatcacaacctcttcagggtggtttccttatttgtcaaaagaggggcacagatgagatgactgccttctagctctgataagcttaaggcttggggatttgaggacgggccaggactgtatttgttttgttttgttttttcagacagagtctcactctgtcacccaggctggagtgcagtggtgtgatctcagctcattgcaacctctgcatcccagattcaagcaattctcctgcctcagcctcctgagtagctgggactacaggtgcctgccaccacacccggctaatttttgtatttttagtagagacagggtttcaccatattggtcaggctggtctcgaactcctgacctcaggtgattcacctgcctcagcctcccaaagcgctgggattacaggtgtgagccaccacgcctggccctgtgccaggactataaagaacatagttcaggctaagggatgagcctctggaggaagatgccagacactttaaagagcaagagaggcccatagacagctgcccagcgggaatgtctacaaagcaatgagggaaggaagagggatacactgtagggtactgtaccttcctttttgccacccctcacccacacctctgccacactcaccacaccctcagggtccaccagtagcaaatgcttaggctgcccactctgcaagccagtgagcacatactggccaggtgtggtcgtgctctcccgtaccaggaagtccccattgagctgcagcagtgcctcagcctcccgccggctcagcttcccatggaaccagggctcccctcggagctgctcagccatggacaccgactggggaggtggaggcacgcgaagagcatcttcgaagggctctggaagtatagagggagggtgaggggaagtagcaggcacaacacacacccaagacccagacttcagggaagggaagtcaggaaggaaagagcagataggcaggagaagggccagaaccaagtagaaaggtggggatgcagagaggagagagacgagcactcactcatgtcaaacaggtcccggggtgcactgccattgatagcaggattggggggcccagcaccacccactgcttgccgggccttgtctaggttctggacgttgacataggagggatcatcaaaaagctctctgcctgctgaggaaagggaggctctacagtgatcccagccctgcctccaacactccccagctctgcctatctcggctcccttcatacctggacagggtggtggaggtggcatctgtttgcggacttctggatctcccccaacaggctgtcctacaggctgcagggataaaaataaggtgagaccagaagccctaaccaaccactcccaccctagccccagcccgcctccatccaagcaacttaccaatgtagctcccaagtggctgggggtctgggcattgggtgcagtgggtcgagcagcccctggagcggctccttcccgaagcctcatgtctaccaccccccccaaggtgttccttccccgggaagtcattatagtactgatggtcaggtggctcttcctcctcctcatcccatgctgagccatcaaagccagccatcctgagggacaggacagtgaagctgtggctgtaaatgtgtggtgggcaggaggagggaaggacagaatagaacagcagccatctattgggtatttactatggattaagcctgaggctgagtgttttatatacataatcatttcattctcctggcaaccccgtaaggtaggtattgtttccttccccacttttacagatgaggaaaatgagggtcagaggtgaaaagatctgcccaaggtctcacaactaaaaggcggccgagctcagatttaaattcaggtttgactttaaagctcatccccttggccaggtgcaatggctcacgcctataatcccaacactttcagaggccaaggagggagggttgtttgagcctaggagttcaagaccagccaggacaacatagcgagaccttatctctaccagaataaaaatactactactcagccaggtgtggtggcatgcacctgtagccccagctactcaggaggctaaggtgggaggatcactcaagcccaggatatggaggctacagtgagctgtgattgtaccactgaactccagcctgggctacagagcaagactgtctcaaataagtaatgctcttgctcttgatctctgtgctatctcccaacaaggaagggaagcaccatgtaggggggtggggggccgggggaggcactccagctccagaatattttaacctctcctaaatattcaatccctactggctccactgcttatccctcaaggcctgaggtgggaaaggttgtaatctcagggaaaagagatatcctcccaaacccaaattcttgatggcttctagaggcaggaaaacacataatgccaagcagagaaatgagcaagaaagagggatgggagtagaaaatcccacctagccagagagagatgtaacttggaggccccggactacaactccaccatgagcaaacaagaaaagctggtcctgcggcaagcagggcctcaaaagtctttcctcctgggccacaggaaacagaagaatagcaggaagtgggaagcagaggcacacaggttattccctccctgaacctctcaactcaagtgtaggaagagcagccctcctttcctaatcctaatccaagagctgctccacactctccccacctgctcacctgtcatgaggggtgaccagtttgggtgggttcctgaggtattgtttgaagcgcaactcgaaggcctggccaatggtgctgatgacatcctgggcaagcccttcgggacactccagaatgtggcaggctgagggcacagcagaggctgtcagtgagctgagcccactgggaggaggcacagacaggggccctcatcttcctctgcaggaacccccactgagatctacttagagtgggtacagatgaccaaaggtcctactcacctcctcaaacagccagacccacccagtgctccccaccatgcctcacctctctgattcacagggtctttggcaacataggcgacatactcggctgtgtcctggggaggaaggtcaaaaaattttacagttctactttactcctgacccctaaaacccagtccttttcagatatccccacaatcctagcacccccacttctctaatcaatgtcttcccaatccctagccccttgctcttctcccaccgcctttgctctgttccccaactcaccggatccccgccggatgcaaatgagatagattgcatgtggtggttggcgatgatctgagaattagggcaggggatgaagaaggaagggaatgccatgtgtcaggcagcctcagggcccagaaccctggtgccccagtctcattctctgggttccttatcccatatcctcatttcctccttccctactggtctcctgctctcaagccctcttcctagattttggcctcctaactagatctccccttagcacccccatcagtgtttctggtccgtctgcccaccttcaccaacctgtttgcagtctgcggccatgaggttgaggctgctggtggagacggtgagagtgattggcattccagcaaatttcaggttactcctccccaggatagagctgagcgggcggctacagggctaaggtagggcccagggtctcagaaggtgagggttcccagcacaggcaaaccacacttttgcctcctggccctctccccacatgccccacacttgcctccccactgcccctccacatttcccagcagcatccctatccccaaggaccccaagtacctttctcctccttgtcgcccccttagcacccggcacagcctcacacaccagactgatggcctccctggggaaagaggggtactcagacccagcgcctgcctgcctgcctcccactcaactggggctgccacagggctgggggaggggaaagccaggccagactcccagggcactccaggctctttgtcatggtggattgaattaagggcctttaatatttgatgacactgagaggccacttcctggctgattgggttagggcctcaatgggtatagccccacccccttccagctaccaaatgtcccattcccttcccaaaggcagcagcaaccttccatctaccccccttttctactccagctccacctgccagctgcttctgccaccttccccacaactcccaaggctggataggtaaggaggatccgggccaaaggggcctcctttcagtaagaggcggaatcactacctcagctttctctcaatcccctttactacgcaaagatcagcccccagcagcagcacccaagtgacccactcccctcctctgtttcccatggcctcactaatcccaggactcccacaatccactccctccccactaacctggtgacctgagtccgggtgttgaagtccagggcacgcattgactggaggacctccacacaacccatgtactaaggggagggagaagaggacagcaggtcagcggctcccccaccccagccccttcacaaagggccctaggactttacccatatggtccctaagggaagtaaagaggaagaagttctgcccacttcccgtggctacatcccacaaccaaggtgaaagacaacagggaatgaggagaaaaagaaaaggcaggctagaaggacctcacacactggggagagagtttggaggggaccgacaggcattggctgggatggagtgacaactccagaaagcgggaggagaatggaggaaagatcaagaagtcattcattccaacacttattaagagcttctgccatgctgggcattgtgctaagcatgccagggtgggggtgggggagtgaaaagaaggaagggggcccaggcaaagctggaagggaaggggctacagaatcggggaagggatgagaaaggtttaggaaataggacactgaaacggggttgttggggaacagcaggaaaaaagagattccggccaagctggagtgagcattagaactggagggggtctgcgggggaatggagaggaggatgttcactcacccgaaccaagtaggaaaccccgggtcccatgactttgtcgttgggatgcagccagccccgcgtgggcttattgacaaagctcccgtggcgggtccactcctcgcccccaagctggcccccttccacccgagtcctgcgcccgccgcctccactcagcttgttcatgtcctggaggaggggtagggggcctgagtctggcatggctgcccctacgatcccctccccatcatcagctgcccttcctggctcccccttagaccctgggcgccccccagccgggttggccagcctcaggttgctcatccgggggaagaaggagcacagggtagtgggactatcgtccccaggcagaggaggcaggatgggccccagggatgaagctgatggggaaggcagctcctccgggggggtggacccagaagccccttcctccagcgatgacagagactcattccggagtggattgtacttgggcttggggggcaggagatccatagttgaggtgaaagaggggctgctgcccagcctggcccccctgccagtttgggcaagggggccaggcagggggtatccccaggcccttagcctggttggacctctgtggcccaggagtcacagaagtcctggggagggagagggacaagtggcttccgctccccagctcagacccagacagtttcaggccccatccccgcccaacgtggagcctcttctctggctgagaagagaacaggctggacccagcgcttctggctcctccccaggggcggggagctaaggggagagaccaatcgtgaggacagtgctgactcacaggctcagaggggctgagcccccaccccgccccaacctcgaactggagcagggggtagggctatccaagcccctctcccctgccctatacaaacaactagtaatctggggagaagtaaagtgggggtgggagggaaggatggaagagtgggacggaaaggaaggagataggaggtctgggtcactcaaaaccggacacacgcaggccaaagggggcaggaagccaggcaggagtacaggggaatgagggaggaaacagaggcagctgggggtggaaaagggaggagatctcagagctcagcatttcccttcctgtcctggttggacactcgaattcccccaccctctctatgcccgaaagctggctggccccagcccaggccacccccaaccgctaccccatacagtaagcctgggccattagcatcctctgctacagcagctgtggactggagctagcgaagtggggatgggaagtaagtggtcccaatggatgcagagcagggccaagaggaagagcaaagctggtgaaaaaaggggaataaagttcaacctggatgatacatcaggaagctaccaggcaagaagggaacaagaggacatgctggtcacggcttgttctctacgtatgccatctaccacaccaagaccgatggctcatagccaagcactgtcctgtctcccctttccacagggcttgttaacacagcacactgtcaagggtgagaatgaggcaatcaggtccccactcccactccaaaccaccccaattcacatccctcctcttacagggccctaagccccaccaaagagcacagcatccttcacaccagggaaggagcctggctggaggaggtggaagaaacagttctccaagagaagtagaaactacaggccaggaagggacagagagatcagaagacacatctgcgtcaataaggacaggagaaaaataagtacaggagaaaggggtgtcaggagaagatgggttgaagctggacacagggaacagtcccaaacccattcctgccacccacggcttcctgccactgctcttccggagaatgccacaggcaaagctggaaagtgaccaaaaaaaaaaaaacaaagatacgtattcctaccgggcgcggtggctcacacctgtgataccagcactttgggaggctgaggcgggtggatcacctgaagtcaggagttcgagaccagcctggtcaacatggtgaaaccctgtctctactaaaaatacaaaaattagctgggcgtggtggcgggcacctgtaatcccagctcaggaggctgaggcaggagaatcgctcgaacccaggaggcggaggttgcagtgagccgagatcgagccattgcactccagcctaggtgacaagagcaaaactccgtctcaaaaaaaaaaaaatacgtattccccccagctcaccttggaattacccttagatttacttcagagaattaaaatatagatagataattatcctgattaacaacattaacacttgaagtgtgttagatgctgtgcttaactcttacatctccccttagtgctcattccagaagagctttgtcactctgccagccaatcctgagaaggaattttatcacttcatttccagccagctctcgggcatagagagaatgaggaaaggattccaccatagcctcacacccccaaaacacacaaacacacactaggatgtccctcatctgtagagatgatgttctgtgggagcctacagtatccagagccagggaaggaccaacgggtgtgggcgttcggaagaaaagaaagacgtatgactcttgaaatttacatagggagaaaggagattgcctactggaagtccaggtgattgggtgtaggggaaaagctgtgtgtggcttcgcagcccaactgggaggaggggacaggggcgggaagtggcaggaaatggcgaaagcctcaggaatgtttccagcagggaaggctgggcaaacggggccaggaggaatgcccagacaagaactctggttagggggaggggaagagacagagaagtagcgactgaactgtcccttaaaaaaaaaaaaatcaaacaacaaaaagagcactattatctacccccactccaaactaccgttcttctggtagtagaaaacttttgctcatgtcacacccacatgccacacaccaacaaatccatggtcttatccacttatgtctaggaaggcctagagctacttctgggatgaggttggtcctgggaagggaaagccaggaagtgaggctgggagtctgagggcaagtctctctctccctctcgtgccaaaccccacgttcagccctttcaaatagttctacccttggaggaggttaagaaagaggaaaacggggacgggcgcagtggctaacgcctgtaatcctaacacttaaggaggctgataagggtggagcacctgaggtcaggagttcgaggctagcctagccaacatggggaaaccccgtctctactaaaaatacaaaaattagccgggcgtggtggtgggcgcctgtaatcccagctactcaggaggctgaggcaggagaatcacttgaactcaggaggcggaggttgcagtgagccgagatcgcaccattgcactccagcctggacgataagagcgaaactccgtcttaaaaaaaaaaaaaaaaaaaaaaaagatagaaaggaaaacggaaaacggctgcctttaatctcactccttacagccagagatgggaactttgacttcccacctgggggagcacgagagtgctcggaaaactgatcccaaggcccaaaaagagaaaggacaggaaaatataagcaggtggagtttcagggattgacgacaaggcttttcagctgatgacccaggtcccacaaagataaagctcctaagggggcgtggtcccctaaggacgcgaacttcagacttctgggcggggaggctttctggacagtcagacgtggattacggagggggcgtggcttcggaggggcggagcttcaacaaattcgaatcgttctttgaagagcagggttttgcccttttgggagataggccttttgacaggagttagccgaggatcgttgctaggaggcggagtttcggagaatggaaggagtaacgaagggtttctcgtagtagggcttggaacgtgtcggggggtggggacttccagaaaaactgggcgacagggtggggtcggagacaaaaaataaaaatcaagtcggggttcgggggagccccctgaagttgggaggtgggacttccggggagaggggtctcaggggcgggacttataaatgaagaccggaagtggggtcccgggagaggggttccggggtgaaagagtgagtcacctaaggagaaaaaagtcaagactcaccagggcctcatggagtctccgcaccgcaccgcgggccgatttggtgccggatcacgccactgccagcttaggttaccgctccaactttctccccgggccctgcctccctggagaaactttattacactcacttccggcctcactaacccctgaccctctacctcagggtccctccttcacgct

SEQ ID NO: 15004 - DNA, 3985 bp, Homo sapiens
ttgtctgggattttaaaatcattttattaatccaacagtacaaaagacccccaccaccaccgcattctgccatcactttgttccaaaaagtagtggagtgagagagcgagagggagcagatccagcaaaaacactcccccaggggccattttacaaaatgcggagcaggggaagacaacacaaaaacagcaacagataaatggggcaaacagaacaacaaacacaagagttgagcagcggggtgggggtggggggttgccatctacgccgttttagtgtgagggacactgggaacgatgcccagaggctgctctcctcccagcctcaaaggttgtcagctccaccagagcagggtcttctctcctcatgccaggaactgagagaagtgggggtaggggaccactaggtctttgccactgtatcttgagctgggggactcctaacttctccgagggccacaccccatgcctgccttccccaccccatggaggaatgtgtgcatgaacagaaaaggagaacgagcagcgctaaggtcctcatcaggccccaggcccatctctggcaggcagtgcttaaaaaataaaaaaagacaaataaagcccagtgcaggcctttggctgagaggaatgagaattgctaattaatcaccaggcccaagaggatatgaaagaatagcaaagagaagcaacaaactccaggctcttctacctttgagtaccatggcaatgaggatcccgccgcatcccctacccacaggctgtgacagggcctcacttggatccttttatcatggaggaaatgaggtatagggctctgcgccttttcaagctttccttcaatcaagccaggaaggcaggggaataagggcgccgaaagttgaagaacacacggagtataatgtgcaacagatgggctgggggaggagggtaccaccaaagtccagactttcaggacagcccaaacttcaaatattctggtctgtcagataacatatcccaatttttggcaaaaatatggtcattaggagaaaagcacgagagaggctgagaaaggaccagtgactttggtatgaagaagatacgtcctgacagcatctctcacctactgtcttgaagccccaaatcaccaagaaactgccataaccaggaactctcctgcttcctcaggctatttggttctctgagggggaaggagttgggtaagtcttggaggaagcaaaggagtgggtagaaaaaggggaaaatccccatttattccctaaagctgtctcccagagcccataaaagggctattgcagggatggcaagaccccaattcctctggccagaaacctttaacacttgactccaaaaactaaggctggagctgtggggttcagtaggggtgttaggcacaggtgttaggggcatccatcatcagcagagggaacacccctgccctccggatcttcctccagccccttttctcttgcagccacactcctgggcctccagaaatagccacaaaatggctctgctcagcagggctttggtttcctggatctctgtagatctcaacatgtaagtttcccaaaacagtgagcaatccaggctcttctgcctgcccacctcaattccttttctgctcccaggagccactgtttctgccccatggggatggaaagccagtggaaacaaggaccaagagccaaacatcaaaaaaatcaccctggaagagcagggagagacatgtgcacttccctgggccacttcaccagcgtcacccatcgttagcagccaccagctgccccatgccctcacggatgtagacagactggatctccttggtcttgaggcagagatcgcaggcccagacggcagaagcttcagtggtcagcagcccataggcgctctcagtcatgcctgtgcactcacggtggaaccatttctggcaggaggcctcacacagaatggcatcctggtcatcgttcacctcactccgacaggcaccacatgggtacaccaagcctgggggaggctgggcccggagcccccacctgccttgccagggggtgccaagctgttggcatctggagtgcccccaccccgcccactgctgttcggggggaaactgggctggttcccattaacagcagcagccggggagcctgagtggggctcctggggaaaagcagtagaagcaggtggattcaagggcttccccccatcctcaccaccagggccaggaaagccagggtccggaccaggaaagggacttgtgttaggcggcaggctggggagcccctgaccaggtctctggagaggagaagggccaaaaggagcccctggctgagcaaatcgttgggacagagaaggtgggcccagctctgctctgggaggctgtcccatggtgggtgagatcatgggaccaaatccccccactgggcccggcatcatctgcccactgggaggactaaagttttgacccagaggctggttgaagggttggctgggaaagttcatgttgcctgggggtgggtagccaggaccctgggggggcatgttgaaagcagggcccataggattgggagggaaggggggtggctgtcgacggagtggctgggggccccctccacctccagtgctgtagcctgggggtacctggcccgccatgcccccctgcacacggaagcctccgaagggcacaggactgccaaggaatggaggggctgcaacccccactttgggggctccgaagtcatcttcaaaagggttggatgcaaccaggtgatccaccatgggagttgggggtggtgcaaactccgtcagatgtgagtatgcagggccctagtgagaaacagttgagggaaagagggtcatggagggaaacacagagctaaaccaagagagcactaccaacacaatacacattttggaggctgatactgtgggcagctcaggtctaaaatcaatatggaccacaggccaggtgcggtggctcacgcctgtaatcccagcactttgggaggccaaggcgggcagatcacgaggtcaggagatcgagatcatcctggctaacacggtgaaaccccgtctctactaaaaatacaaaaaaattagccgggcgtggtggtgggcgcctgtagtcccagctactcgggaggctgaagcaggagaatggcgtgaacccaggaggcggagcttgcagtgagccaagaccataccactgcactccagcctgggcaacagagcaagactccgtctcaaaaaaaaaaaaaaaaaaatggaccacaggccaggcacagtgggtcacacctgtaatgctaacattttgggaagccgaggcaggaggatcccttgagcccatgagtttgagtagtaacacagcaagtctctgttactacaaaaaaaaaaaaagaaaagaaaagaaaagaaaaaagaaaaaaaaaaagacaagaaaaagagggtggagagtggaaccaacatagtgcagtaactatgttttaaaaacaggcagaactaggatggaatcccagctctgaccctgaaaaacaacctcaagactgtggagcatgtatttaacatttttaacccccagatttctcatctgtaaaatagggataatgcctatctccccaaactgttaaagcatgttagcgcaatccctggcactaaaaaaaggatcagtaagtggtaggtgttacgttatcatcaggaggaaaccaggacaggaaacatggaggagactggaaccctgcgtggtaagaactttggtcgaatcatctcttaggagaggatactttcccctaaacttgttataaggttcagcgaaagaacaagaagcaaagcaagaaagacagttttctctctcctccctgcagctgatacaagatacaaacagatactggaatggcagagtagacagtgtgccgccaaggggctgctgggaaccaaacccaccaccaaccaccattcacctgagtatttgacttccttcgcttcttttc

SEQ ID NO: 15005 - DNA, 5219 bp, Homo sapiens
tttgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcggttagtgctggcgcgggacaatagcgagggtcgtgagctttggccgctgagggcacaaggaattagtaacaggaactgaggcgatagaattggcgcatcgtacgaggtgcgaacgggcaatggtgtgatattgtggaaggcgtaaggcgcatgcgcggaggtgggaggcgctcgtaaaacaaagtggttgcgaatttggagtcgcctctcagtagagaggagagaggggtgggcgtggttagggtactgaccaccctcacccatgaggctttctggatcattctctgaactttatcgggcaaacttaacttgccttgtagagactgtttcacagtaatcttgtcgaatccagtgggagaacgtagcaaaagcggagctggaagtttcctggcgtccctaacaggagagtagcgctgagagagttgaatattgcttattaactcgtgaaaaagacaaggggcgtggttgtctggcttgtgtaaggaaggggatcgcttgggactgcaatggaataaaactggctaggagcattgagaaaatacttaatatgggtctaatagatgccctttaaatatcaaagggaacagttacggaatacttaacaggtttcaggtgttctgctaaagtgcaaggataacacatggtctctgctgttcacaaatttaaaaatctgtgggtggtaccgacagacaccagaaaggtgacacacgctatgcaaggagccattacagggtgtgatgggagcacacaagacttgctaaggagagggaactggcgacccgaaggctgcggcttcctagctgtgagcgggggttgaggtggggctagaaagtcagtcccctacttttgctaactccaggacgctcccccatcccacgcttcgagaacgccccccgccccgccaccgccttggaggctgacctcttactttcggtcggtcttcttccctgggcttggtttgggggcgggggagtgtcctaagggccaattcagcgtgatgtctctttcaccaccattgaaaacgaaaccagtagtaaactacgcgtgttttcatttatatgtcggagataaaaacacagggacagaaagaggggaacaacagacattggggcctgcttgagggaggagggtgggaggaggtagaggttcaggaaaaaaaaaaactgtcgggtactatgcttagtacctgggtgatgaaataacctgtacaccgaacccccgagtcaggattttacctatataacaaacctgcacatgtacccttgaacatgaaacttaaaatactgagaggaaaaacggaagagggaatgttggggaaagcttcctagagggcagagcctgagatgagactctaagaaaaaggtatgtgggaggaagcacctcttgactgaaattgtttagaagacactggatagccatctgccaaggatggtgatgatggaatcctggcactggatgtggcattcgggcttgataaattttaagtgcataatctagattgggaataagggaagacacaggattccacaaatgttggcattatgctaatctgtattaattgtaataattaagaccacttcctggtttgtatcttgtctcctcagttggagaacataaaatgaaaacttgcttttcttgtgtctcttcacccagcctagttcagggctttgggtcttccagagaactcgatgtgcattgacaaatacataatcatctttatgccaagacggctccagaccctcctttaattaactttcttttcctcagctgttttcctctacatctgaactaaactaacttaaaactgtatgtgcttataagagatttgtggagctgggaaggaatcaccatttcatcccctggaagatgaaactcttggcagtggcactttggtttaagaggggttttttggtgtatgtattgaagccaaatttcgtgccagggtggtgttagaatgtgagctattttcattatatttggactagaattttttcttttaggagaatggtggggaatcactgttactagcacagagggagaacttagtacattttcattgagcatgacgaagactatgtggattagtttgattcacatcagggtaataatttttttgctatgaagggagacttatccttggttagaaaagcacggaatttacccagaaagtctcaaggtacatccctccagagttaggaaaataagattcaggatagatttaattttttttttaagagacaaggtcttgctttgttgcccagactggagtgcagtggctattcacaggcacaaccattgtgcattgcagccctttcttttttcttattttttttctctttttttgagacggaatctcactctatcgcccagatctcagctcactgcaacctccgcctcctggattcaagggattctctcctgcctcaacctcccaaatagctgggattacaggtgcatgccaccacacccggctaatttttgtatttttagtagagacggggtttcacgttgttggtcaggctggtctccaactcctgacctcaagtgatccacccacctcagcctcccaaagtgctgggattacaggcatgagccaccgcccctggcctatttcttctgtattttaatcagatttcaaacttcatactgtatctttttcaaactcctgggttcaaatgaccctcctgcctcagcctcccaagtagctgggactgtaggtttgtgccaccatgcctggcttagattttaaaggacaagatagttcatttcatcctttgtaataacttgtccacacagtacttcataaaaggcctttcctcgccacaaaataacttctcttccttccttctaattattaacactgtgtgctccgtggggctcccattatgttgtagataatcaactagaagactataaggtccatgaaggcggagaaaatgtgccttgaacttaagtgctcattcactggaattattcactaatttgtatttttaatatactctcggaatttatataacatagcctgtatttctagctgctgctaccccacaataaaattatataaactctgacatcaaaaaccagtttttctttcctttcttggccttgtaaacaggcatttgtctaagagactgtatctggtactaacataaattccccacttccccgtttctgttacagacatgtcatgctgcccaaggacatagccaagctggtccctaaaacccatctgatgtctgaatctgaatggaggaatcttggcgttcagcagagtcagggatgggtccattatatgatccatgaaccaggtcagtgcactggctaaaaacaaccatatagaactgctacactgagagaatgaaagaataagattgtataacccaaatagggagataggaaatggtttactggttccttccccctccagtcgtgggggatttttttaaaaaaaaactagtgaccaaaaataagactaaaatatctgggaagttcagagacaacctgtcactgaaaaacctcctgtaatctttcattcaatcagagggtattctttttaaggccacatatagcctgatcatagcccctgcctcattctccatcgaaaacattcttggatgtgttctaaataagcaaaggaaagtatatttattgataagacaccagacacccagctgccaggcaaaactaataagggacaccctggggctgtataaacatagcaaaagaactgatattaacaattctgtacttggcagacagtccagacttctgggtctgcttctaaggccatatgcttaagtctttatttagttataaagatctgagtgggtgatagctggggaggtggtagtggaatacactataggttgtacatagaatggtgtgagcttgtctcttagatttccctcactctttcagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatctagtgctgtaattgtacgggttttttccccctcactcagggtgagcatcatcaatatcatggttctaattatatgcccttcagtttgataatgaagctcagctctttgctgataatgaggtttaacattgagataactggtttttaatctactttaagcagacttgctgtcaaacatctactgaaatatatttcactctaactactagcctgaggtagaggttatatagggacaacttcatctcatccaaacaaatgaactgcttcctacagtcggggtgctgcctttaacatagtcccaatatttgaatggcacacatggataaaaggatgctgtcagtcaggggctgcttgtgtgtcccaattcctaataggaataataggcatatctatgacctattcactgtgccccttggttggggaaggttttcagctgttcttaacttggcttgggcgttggaatcacctggggagctttacaagtactgatgcctgcctgagtcattcttaaggattcttaattggtctggagtgtggactgggggtaaagatttcaggcatcttatgcaggtaggtaaagaactaagctttgagaaaacaggtgcaaaatgtagctgtttaagaa

SEQ ID NO: 15006 - DNA, 12174 bp, Homo sapiens
atttaatcacaccctgacctgctttgaacataaccttcaggtattttatatataatatttaaaattaaaatgctgccttgtacaaaggaataatgtgcagttccaagtttttagagcactaattattgatatttatctaaattcatgatgtaaaggagttagtggacctggatttctgctcttaagtaagttcttctacttacaaatcatgaaaacctcagttctctcattgtaaaatggagataatatctatcctgcctatcttaaagtattttgtaatgagaatctggtgagataatgattgtgaaaacattgattgaggtgtgtgattgtttaattaaaacacaatggttttcaatctgacttacgtaggtattttgcagtgtagtatgattctgtctataggaagtttattctttgcctgaaatttgcttaagtatgttttacctaccttaaaaagcactgtttagtaagataactttgagtattgaattatgataataaaaggtagctttaagaatcttaaccttgtagattattgccatctctatctctgactcttgaattttggtattggaacttgcccggtcgtggtgaaggacgaggttggaactctggttaaaatgtagttttgaaacttacataacaagtaagtaatccccatagtagatgtacacatgcttagggtataagcatgtatgatttcttctgtaataaatgtggtaacactgaattatgaatttccttgagaataataaaaattgggccaggtgcagtatctcatgcctataatcccagcaccttgggaggccaaggcaggcaggtcacttgaggtcaggagttcgagatcaacctggccaatatggtgaaaccctgtctctactaaaaatacaaaacttagccaggcttggtggtgcacgcctgtagtgaagtagaggttgcagtgagttgagatcgtgccattgcactccagcctgggcgttgcagagagactctgtctcaaaaaaataaaataaaaaaaattaggtgaacatttctcagaatttgttctgcagcatgttaatagatgtcctatcagaaagggtttagtattccattaaggttgggaaatgctttactacaggacttcagagcctttagtggactgatgtgtgttgtaacactcaaatagcaatttttctataaagtcatcccttttatatatggcttcactttccacagtttcagttacctgtggccaactgcagtccaaaaatattaaatggaaaattctggaaataataagttttaaattgtacaccataaacagtcttcttttcatttaacttagagtacttgtatgagtttggtagatttctagaagtagaattactatattggcagcctaagaaaaagacactagagaaaattatctccaaatatgatgagtttattagggaataagaaagaagtatggtaatttggaatgcactggcaaaccaccagtacatccagtgagggaagggtaaagggaagcttttattagcaaaaagggagaggttcacacaagctgcttggaaactgagttcattggttcctgaggctcaaagccaagttgtcagttcattggtggcgatgccattactgggcaagtgttcttttgagtgcatcttatctgaattactgcagtcctaaagaatggcagtgataaaccatgtgaaagcaggagttgcaatgaagggcgtgaaaggatttcttgtggggtttttagaaagtctttggaaacaaggactctttttgtctctattttgtcttggtctgtcaaaaggtgatttcatcctaatgtctgcaactttcacattattaaaagatatgtgcattttaaatttgaataaaaattgtggccaggtatggtggcacctgcctgtaatcccagcactttggaaggttgaggtgggaggatcatttgagcccaggagttagaaattagcctgggcaaaatagcaagaccgtgtctcaaaaaaaaaaaaaaaaaaaaaggttaaattactccccatctagattatgtgcacaattttagttaaatggattatgtgctcaatttttttttttttttttgagacggagtctcgctctgtcacccgggctagagtgcagtggcgcgatctcggctcactgcaagctccgcctcccgggttcacgccattctcctgcctcagcctcccaagtagctgggactacaggtgcccgccaccacgcccggctaagttttgtatttttagtagagatggggtttcaccgtgttagccaggatggtctcgatctcctgaccttgtgatccgcccacctcggcctcccaaagtgctgggtttacaggtgtgaaccatcgcgcccagccctgtgctcaatttttaactaagtgcacaattgttctgtgaaaaacaagcaatgggctatttcttgtagcagactaaggagagacttagtttttctgtcaagcagatggtgagggtaacattgttgggccaacatcagtgtaattactttgatttttctcttttctctttcatcccaatgttcagttaatattctttcttcatactacaaagtaaagaataaagggcatagaaagcaaaggtgtgaactgactgtttagcaaacttattcttgaaaagacaagtgtcagtctagaagtacaaaatattgagatttagtagcataatattttatgtacctccactatcctcattttaggttatacaattctttggtatttggccctttttgttgactagaaaggcctggattatgagccttgtgataagagagttgagtggggatgcagttttggtgccttttccctttccatttaaaaagttctgtctcagtaagataaactatggtgttcaagtcagcataggcaggaacctattttatttattcagtgagagtaggatagataagtgagggtttgtgatgatgagataatttaggaaattttgtatttagttactagtcatttggcatatgaattattgttatcctcagttaacattagctaatgcagcagttttgaaaatttagaggcacctagaaagttccaaacagtttgccatctgcttcacataccgggtctctaatccttcggacttataatacaggtagaggtcgttttattttatagatgataaaactgagactcagagtgatttagtaacctactcaacatcacagcttagcactttaacacaccatattgtttcccgtcttctagaagcgtaaatagcttacattaaagagatattgtatataatgtttattgtatatattacatgtgcctttgtcattttaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcagtaagtactttgcttctgatgtgatacatattttagagtgttattgaatgtaccttcagtatgattattatttttggtgatagggtggaatctgcatattctgtcctcaaccaaaaataactagttataaagtagtaaagttttagaatatcctggtctgttaaaccaaaatggatatttccttagtagtctcatggttaggataaaaataaaacagaaattaattaggtacttcataagtgagttgatgctttggtacattttaatctttttaaatttgaaaatatgtgccatttgcagaggtgtaggtattgttatatgtttatatttcagtttcttgtgcacttgttgctaatttaagaagtttctgagctgggcacggtgactacacctgtaatcccagtactttgggaggctgaggcgggcagatcacgaagtcaggagttcaagaccagcctgaccaacatggtgaaaccccgtctctactaaaaatagaaaaattagccgggtgtagtggcacacgcctgttatcccagctattcaggaggctgaggcaggagaatcgcttgaaaccgggagggagaggttgcagtgagctgagatcgtgccagtgcactccagcctgggcgacagagcgagactccgtctcaaaaaaaaaaaaaaaaaaaaaaagacgtttctggatttcactacatgtttcagaagccattcctcaatcacttcctattccattgttttattttcttatatctattaccatctgaaaatatttatttatttatttttagtctgtcttcctcactaaaatataagccacatgaggacaaggacttaggctttttttgttcactattcagtatttaggacagtatttaggacagtctagcatataatgggcttaataaacatgtattaattgaatggtcaaaaaaaatttttttttctccattttatagcctgcctttacatagggtgccactagatggcaatcatgcctttttaggcactatgatgctggagttttggggcattagaggaaactgagaaattattggctcaaagtagagaacttgaggtcagaattaatgagcttaagaattgagaatgtgtgaattatcacagcagctcagagggaactataagaaccaataatattcgagatggtaaaaagtacttaaaatgaaatgtacagtgtggctttttgtttgtttttactgctccattcctattgcctaaaacagtacctggtttctagtaggctctcaataaataataaatattttgtaaatgaataaaacagggcctaactatattcctcttcatataagttctttgtttgaatgtacaaatggttgacattctagaatactttggtcagtattatggacttagaatatgaaatttctgtatggatataaatttctacaatgactgtattttgaaccaggtttttttcctggcagaagaagttgtcctcaactatcagtaggtttttagaggtatgtattgagtctaaattctagattcctgtttagttattagcaaaataattataagaaattgaagacaagttaaatataaaatagaaagatattgtttgctcttgttccagatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcgtaagttttttacaattatttattttatagataaaagcctgtattttaaaaatttaggcctgttttagaaatgatagctactctgagaactcaaagtagattagcctaaaaggactctctgctttaagttttacaatcatgcttactagtgaaagagatctgtgaaaattttataagtgtggacaataaaaagttaaaacagggctaggtgcagtggctcatgcctgtaatcccagcactttgggaggatgaggtgggcggatcacgaggtcaggagatcgagaccatcctggctaacacggtgaaaccccatctctactaaaaatgcaaaaaattagccgggcatgatggcgcatgcctgtagttccagctactcgggaggctgaggcaggagaatcatttgaacttgggaggcggaggttgcagtgaaccgagatcgcaccactgcacgccagcctgggagacagagtgagactgtctcaaaaaaaaaaaaaaaaaaaaaagttaaaacacagtgtctttcagatgattaaattgagaaagctagattacccctggaataaggttggcaacaacagaagaataacaacagaggctttgcactcctaacatggcaatagcagggagatacagacagctcttagacccatcggagtcatggtagaaccacctaagtgtggcaggcaggaagaaactatagctgacataacagacagtttgtttgtgaacaaattggaatcgtagttccaaggagattacttgatataatagtatatgctcaatacatattaattccctttctttctccctatgaaataggccagagcaaaagaagcactaactagagatcccatccagctaaggaagagtggcttctaagtcacgtggctttcttgtttattatcagaatgaaagtacaggcttatgccttaataattttagtttttaaaaaagagaactgtttaggggaaaaggttaattttcttttctctcaaatactatttgtagtctaggaatgtctgatataaaaattcttttccctataaatttcgatcactacttcatctaacttcacttctaatatatctaatttttttaaaaaaaggttacctgtagatcagtttgaactgaatttgtaatgttttgtcaccttaaaatgctagctactagaggggagagtctttgtcatgggtgtatttattaaaggttttttgaaggctgccagcattctgtaaatatgcagtagctcaggtccttaaagcacttacttagaataatagcaaaatattgtgggcacctcaccattgagaaactatttttcagagcttggtatacttttaaagtttagcatcttatttgccttgctaatctatttaactttatggaaagtatttactgcttctgatcaggattttttgtttgctgtcaaagtaaaagtcactaccagtgtcactatttgctatggaagccacaaaccttgtagtcatttcttaattattttctttcttttatttttccattcccacattcccctctcatccccttttaattcattagcaagtatgctgccagttctgcttagtccgtctctctccctccactggtaaaccctagcccaaaccatcttcatctcttatctgtactaacgcaagagccccttaactggtatccctccttccatttcttgatctactaaaatccatacgccacatagtggctagaataattttttaaacacaaattcaccatgtttctctactaacttggaatgcttaatgtgttcccattgtacctagaataaatccaaacttactttccagggtctgctctccaagctgtacatgacctggcccatagccacctttctaaactcgtcacatccattctcctcattgctcatggtgctgtggacagtctggttcctttctgttcttctccactaccaagctcattcacactgccccttttccaaggcccttccctctttacttacctggcttcttgcaagccaggtcttagctctaaagttacttgctcaaagagaccttttatgactccccagtctaagaatacacctctccatttgttcttctgtgccgtctttctttaatggcacttaatcacttaaactaatttaaattaaataattggttatttaaatcatctttttcatttattctctactttatttgtttgtcttccctgcctgaagggaggagctaactgcattagaggtgttgaaattcaccgttagatgatccctgggctagaattttaaaggatgtggggatttatcaggtagggaatataaaggcaaggaagatgtaggtgtatgtactcattcgtatttaacttgtccagtttattaagtcatttgaattttgtcagaagctagatcacttctagtagtttttaacaaagtaattctcaaaaacccaaactattgatttggtttgcctcccaaatctactgaaggcttaagaagtagattttagtttaggccaatgtttttagtttaagttttccctttattttaagctgaagcagtacactcgtccaggaagtcatgttgtgattttccacttacagttgatagaaaccagagacaggccgggcgcggtggctcacgcctgtaatcccagcactttgggaggccgaggcaggtggatcatgaggtcaggagattgagaccatcctggctaacacggtgaaaccccatctctactaaaaatacaaaaaaaaaattagccgggcgtggtggcagacgcctgtagtcccagctactcgggaggctgaggcaggaaaatcgcttgaacccaggaggcagaggttgcagtgagctgagatcgcgccactgcactccagcctgggcgacagagtgagactccgtctcaaaaaaaaaaaagaaaaaaaagaaaccagagacattggtaggccaggcacggtggctcacgcctgtaatcccagcactttgggaggccggggcagacggatcatgaggtcaggagatcaagaccgtcctggctaacacggtgaaatcctgtctctactaaaaataccaaaaaaaaaaaaaaaaaaaaaaaattagctgggcgtggtggtgggcacctgtagtcccagctacttgggaggctgaggcaggagaatggtgtgaacccaggaggcggagcttgcagtgagccaagttcgagccattgcactccagcctgggtgacaaagccgagagtccgtctcaaaaaaaataaataaaataaaataaaaaaagaaaccagaaacactggttctcatccttggctacacatcagaattatctgcagagctttaaaaaagtacaggtactagggtcccattgcagagcttctaaatcataacccctacccaagttttgtgaagctctgaagtagggagactcttagttactcagtataaaatactctcactatgggcatgattgtttttcatttctagaacatgagaaacattcatgtttaactataagtacaaaacatattaccaagccaaatagccatgatttgttttattaaccctaatgactcagtcccattagcatcaaatcagaattgatggtaacgtattttgttagcagccatatgtgtttgtgtgtttatataacataaaactcacttttctttgaggatcattaaaattttttttttacaatacagagttccataataatatacaactcacttttctttgagggtcattaaaatgtttttgttttttttttttcccattacagagttctttcactgatttttttttcatctgaaaatagaagcagttttctttctttctttccaatatgtatagctttccttttctttctcttgccttgttgcgctggtgataaattagtggcatgatgtcaagcaagaccaggtattttcgtcttattccagatcttagggggaaaaatcattcagtctttcacagttaagcataatgattgctatagaatctttgtacatgctctttatcaggttggggaagttttcactgaattcttttaagagaaattcagatttggatttctaacttagacttttagatgtataattttgttattctaccttatagcactttcattgtctaagtacatttatttcacgtacattacatatttaagattgtgatgttcaagaagatataaatgatgttgttttatttgtactgcttctaacaaagtcatgtgcaatttctaacaaagttatgtgtttttaaggttggtagaaaaaagttttaattaggttttaattcttataaggctggaactgttaggattcaaacatagaattaatagataaatactatagattacataaaaatagtaaataatcatgtttgataattaaatttaaattaaaatataattcttttgatttatctagccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaactaacatttaaaaattaatcagttacagtaaagactttgaaaaagaaatgtacttgttaggaagtagcttaattaccccccattgcagtattattgttatatatatagttaatatgttgtacatcacaataatatataattcagtctctagtttccctagagtcatttttgaaaccactgattgcaaacctccctgacaatttttaaaagtagtaagccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgactttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataagtattaagcgctaccctaaagtgtgtaagtttttcattttgtcatattgaaaaatgatttgcatagtactgaatgttgacacacagcttatatgtatttacaagaatatctttaagtgtttttttgacacattaaaataaaggaaataaggaaattgtaagctttatttggatttttaaatacatttttaaaatttcagatgtaatttaacatcacatttgtttttcaggtattgagtttagatgcctacttttatgagtaccatcagctggacacagtgtctcatacctgtatttgcagcactttgggaggctgaagcagatcgctggagcttatgagttcgagaccagcctggacaacatagtgaaacactgtctctgcaaaaaatacaaaaattagctgggtatggtggtaagtgcctgtagtcctagctacttgggaggctgagatgggaggatgtcttgagcccgggaggtggaggttgcaatgagccaagattgtaccactgcattccaacctgggcgacagagccagaccttgtctcaaaaaaaaaaaaaaaaaaagaaaaaagaaagtactgtctgtcttaaattttgctgcaaataaaaatgtactttggatt

SEQ ID NO: 15007 - DNA, 1284 bp, Homo sapiens
taattaattttttttttttttttttttgtagagacagtgtctcactatgttgcccaagctggtcttgaactcctgagttcaagagatcctcctgccttagcctcccaaagtgctgggattacaagcataagcaccacacctggctgaacatcagatattttaaagtgtagcccagagtctagttggtaaatgttacttatattgggactagtattttctaatgtttctgggatatgctccctataaaatgaaatgttttcctggaacaatgctaattaggattgcattcctggccaaagacatgacatcaaataagtaatagacatcaccagcaatgaattttgaaaagcaaaaaatactattaacctatataaccatttaaaatttaaaaaattatgttccaagtacctctattttctgagctagaagaaaccttagaggccatctgatgatagattcccagagctggatggatccctagggactacctaatctgactttctgtccactgcatggattcttctaaaaagtatgtcacttatttccctaccttattaagactaaataagtggaacatcatagagctctttatttataacagtcattctttgatagtcaactcttaaatggagacttgagatgcttaaatattgtactactgtgcttatcttgtaaagatttcataaaatgatagtattggttattttaaaaaggctttggcttatgctgaattatacatgtagcaccaaaatgttacaactctactaaatttccttgttctaaactattatattagctataataaatattagtcatacatgtaacatgtttaatgacaaataactttctttatctccttggaattaaagagggcttttaaaagataatttgactgatccatgcttcttacagtgtggagctttgcaatgatgattttttaaatatgtttttcttgtgataaacaggtattttttaaaatctgctgggtgtggtgactggtacctgtaatcccagcactttgggaggctgaagcgggaggatcacttgagcccgtgagtttgacaccagcctgggcaatatagtgagaccttgtctctacaagaaattaaaaaactagctgagcatcatggtgtgtacctgtagtcccagctactcaggaggctgaggtgggaggatcgcttgagtctaggaggcagaggttgcagtgagccaagattgtgccactgtactccagcctgagtgacagaacaagaccctgtctcaaaaaaaaaaaaaaaaaatcca

SEQ ID NO: 15008 - DNA, 15024 bp, Homo sapiens
aggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaaggtaaggagctcttgagaaattgtgttttgaaacgtcttaaagttagagaagttgcgaatacagtatgaagaactttcttccctgaaccgttaccagcttgatacccattaccctttgatcactgttagggtgtatgtcttgcaaacaaggggccctcttctacatgactagaatgcagccatcagagccggggttagcaatgagctatgggttcccatttatcctgataatgtcctttgtagtgaaaggatccggttcaggatgcactattgtgtttagttgtcctgtctcctggatctccttgagtctggagcactcctcagctttttttttttactctgatgacctgcagtcttgtaagggggcaggccagttgctgtgttgtgcccctcagcctgggtgtgtctgatgctccctaagcattggattccactcatgcatctcgggcaggaatagtgcacaagtgctcctgtggcctgcccattgagtcccatcaggtggactgtgattcgctttgttccatcactggtgatgacccttttgagaattatttatgctgattctctacttatcccaggtttggctagcaagagttccttcacacaggcttctatgtccctttgacctgtccccttgttctttgatcatttccttaccttctagcacacaatacccaagggtcatcttatactttccataactcagccctggaatccatcatttctccaaggttcctttgagtgatgagtggtatttagaaggtgctagttgtgctcactgctgttggttattgttctgaggcctgagtggtcgagggtagggagtgtgtgtgtgtgtgcgtgtgcgtgtgcatgtgtacacatatttatgaccatatttacttgtgtaactatttgtatatactgaaagtcatgatttcacaccaatacctccagttccggtctaacaccacagggttccccttcacacttgcaatgcccttctctctctttttaaaatttatttattcatttatttttgagacagagtctcgctttgttgcccaggctggagtgcagtggggtgatcttggctcacttcaacctccgcttcccgggttcaagtgattcttgtgcctcagcctctcaagtagctgggattacaggcatgcaccatcatacctggctaattttttgtatttttagtagagatcaggtttcgccatgttggccaggctggtcttgaacttgtggcctcaagtgatctgtctgcctcggcctcccaaagtgctgggattacaggtgtgagccactgtgcccagctgtgtcacgcccttctctgaccttgagaaacttggctccctctattctcagcatcctcagttactccacccggcccctgtaggtatgtaatcaacttcctgtgcctgcctccccttctcatatgtgccatccccaccctgtttggtctcccacacccggggccaggcacggccctgcatggacacccttgcttctttcactcaggcttccagatctaggctgctgggtccctgtcactgccccatgcctgcctgtcttcttccttccattcaggctctagcatcccgcaccactgctgcagccccaaccctgcacagacctgccaggcttggccctacttttttttttttttttttttgagagggagtctcgctctgtcgcccaggctggagtgcagttgcgtgatctcggctcactgcaacctccgcctcctgggttcaagtgattctcttccttcagccttccaagtagctgggattacactttgccagccaccatgcccagctaatttttgtattttagtagagacggggtttcaccatgttagccaggctggtcttgaactcctgacctcaagtgatcctcccgccttggcctcccaaagtgctgttattacaggcatgagacactgcacctggccttggccctgcttttaatggttctgacttagtggaattttccagcagtgtttctttcacccttgtaatttcagggacgggcagctctgggtcatatttatttcagagagtcagtcaaggtaaagaattgtctctggtggctgggcgcggtagctcatgcctgtaatcccagcactctgggaggctgaggtgggcggatcacctgaggtcaggggtcaagatcaacctggccaacatggtgaaaacctgcctctactaaaaatacaaaaattagttggctgtggtggcgggtgcctgttttcccagctactcgggaggctgagacaggagaattacttgagcccgggaggcagaggttgcaatgagtagagatcatgtcgttgcactccagcctgggagagagagcaagacactgtctcaaaaacaaaacaaaacaaaaaaaagaattgtctctggacttgaaaggactctgtatactttcttaatacagatgtgtgagccagagagaactgggaatggagtcatccatcgttgagttgaccttgcttgcacaccttgtttgggctttcctaaatgactgaggatggctcattgctccactggcctcccagtttggcagaataaggcaaatgtgatgtgtgaccgcagtggtgtgtgatcagggcatggcgtgtgatcaggactgtgggagatggcattgttaatactggtggaggccaaagaaggcactagtgggtcaacttcgtaccaggaagactgtgggggaagagatgcggcatccagggggaagaccgagtgactgtggcagcgagaagggaaggtctgagctacacagggaggagccaatgttagtacagcctgaaggcacagcacagcctggcattttctgtgagcagcagataattgggtttgaactcagatgcattagagaggggtggggcagtggtcgaggaggctggagtggtaggtgggccagtcagctggacccagcccagggacactcttgaatacagtagcagtgtgcagggcttacgttgcattggaaaggcagcgggtgaactgatggggaggtctgtttgccggaggctgatgtctgttgagcttcagtactggccctctggaggcagtggtgaggacagactgcagtagaagattgtggttaagctctcttaaggacacaaggccatattgaaagtgttttagaaaccacagatcctttgtagtgctttccaaaatgtgctccctggggcacgggtatcagtcactagggtgcttttccagtgcagattctcatgtcctatcccaaccctgctgatctgggctttgtaggagaggggccctggaatttgccttctgaactttgagatccactgaccttttgtataattaagagtggacaatggggatttatgttattacttccacttgattgagcccacttacccgagtgtaattggggcacagaaagtcgtgggacaggtcaggcggatcacaaaagacttctcggggtggtgcttgcccctccgagtctggtgagggagtaagtgtcacatgcagctgtcacagcactttcacttcacacctctgttcaagctccctgaagagaagtaacagttaaccatggctacttttcttttgaaaacctgtagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtaggtttatggaaaaaaagaatgcctttcatctgtggttgctttagacaggcactttcttcctgcagcagtgatatttaggatagacatggaagttttacgctctgtttggatctaaacttccttgtgagccaaggtccatcctgagccggttgactgaggtctgactcatggcatggctccttcttgctgggtgcttagcaatgacaagggactgtgctgaatgctttatgtgtgtcagctcattgactcctcatgagactctgtgaatggttacttttattcttgccgttttacagaggaagacatggaggcctggagaggttaagtgactcgctccggtggccccattaacaagtttcagagcatggcttggctctagtctgcctggctgggctgctcatggggacaaggctggtgtcagaggagtcaggtgagctgggtcatgcctcgaatcatggtttttctctgtcttccttcttcctataggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaaggtcagagtcagagcagattgtgccttgtcttcaaggcttgggcaaacttcgtttctgtatcggttcaaagatgatttaacctctagaatgggttcctagtttgtctgctgagaaacaaaagttaatttcacagaaagatctgcacttagctctacttatatttggagtcagattaacctgtttgtagttaattgtactaaaaagaataagacacttggaaatagaggatcatgaattcaccacactatggcccctggctgtggggcttgggggaagccctgtgaccagcagcatacgggctttggggtgggcgccctcctgcagccttctccctctgtcccaggcctctctttctctggggcctccaaccaggccccttgagtccctccattgcagtgcctcttctcctgtctttccttcttgccccctcagtctcctgctaagtccttttgtgccccattttgagtagtaagtggtttcattactgtctacccactgcccactctccctcccctttatccaggttaatggagagaaaaagaggatgaaatgagggagcgggtgaaggcacagaaacacgagggctcacctgggcacctgggctgctggccctgtgtcccatccacctcttggtttatttgctggatttatactggtccatctgtctttttccttctttctttctacttctgcagcacgtacaaggtgtgctgaacttggaagggttatctgaagttacagtgcatagcagcactcgggaaggagagtagggtggggaaataagcctgtagacagaggatgcggtggtggggaaggtaacctgttggtgggtcgtttgctgtggcctggtctgctggtctccgggaggaagcccagtgcctgccctgcaggaggaggttgcgtccctagtctgcgggatctgacttggttctggatcttgcctcttccagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgtaagtgcttgcatggtagactagtgcaaacttcgtcctggctggcaccagttcatggatcacggggggattaacccgggatgaattagcttcctgttaggacagaaaagccaagatgtgctgttccttgtggtaatcactgtggttccactggagcaaggcgtccagagcaggatgcaagcctaggcagtgacctctgcctggtactggccaatttacacttgtcatttatttcagacagaaataaggcagtgattattttaaagtcccctttgccagttggatctgtgtgtttacaaagaaatctcatacccatgtgtgtgccagtctacggccctagctatgatccacataagctgtgctgttcgctggtttgggatgaggaggagatagcagaattgccaggtgactggtgaggtctgagaggtgatagtcacactgatcccctctgagtgtgactggtgctcagggttgatctttgccaaaactgaacaaggccaagtctgttgaagcagtttttacttcataaacagaattaaggaggcagggattatcttatcctttttttttttcaccttttaacttctggttatattaaaactgtcttggcttattttcacaaataaatgaggggccacgaattgttgcttcaaaaggtccattcagtgtttgctcttttaggagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagccattgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccattcagcttccagcattcctcaactcccagcccctcttccttcatgtctgtttcccctccaccctctgttatattgaggcacgttccagatgtcattgtgctcatccagtaatgttgcggcaggtgtctcaggaggactgaaaggccttcactcctagaaacattagtggtaatcccttcatgtcatcaactgtccactcaaatttccaccttcctacaaatatcagctctcctccctgtaaattattggttggtaagcctcttaagtcttaaaaggtaggttcccctccatctcttttttatacaaaaccaactttttactaggctttacttctgaattaaattcaagcggcggctattgacagcagcaagaacctttgctgtcccacgcgttcctcctgcagtgttctctgtgatgctgcttggaaggctgatggactgttcagctggtgtgatgatttgggtagctcagagccctcatggttggggacctgacacatgaagagccctgaatatcactatgggtgagtgtggccttactttttgctgcttcacattaacggtttggctttgcctgcagccagtattctgaccttaatgtcacacttgcagatgtcagcccaggcttggtacaggggcaaaccttttcaggcttgagcagaacccagttaggttccgggtgttgactgttctagaaatggatttccaggactacatgagtgggtttgtgtgttttccccagaaaatccagaactgatgataaatagaaatgtgaaaaactacttcagttacttgactgtttgttagtaaaaaaaaatcagtaattcatccttgcccacctaggtaggcggtttatccaacttctgggtctcttgcccatggaaatcaccatcttggatctgttgctctcccagaacagtattatgaatagggctaaaggtcagaatacccccactgcccttatgacagatgggaacatctcccaaataagacagtctcaagcattcatgtaataaaataactttattagaatcaggaatttgttaaaataatatccttcacatatagctaaagtgcaaattctcttgctctgtagtagaagcaagcacatctgtcagacctccgtggtgtgcttataaaaccaagacgagaagagttttaagaagtacctctggcagcataagagtacgaaaacacattttataaaggtttgaacaattatcatttggagccatttcatatatcgtgtatgtcttttcacttatttttcttaacctttcaaaaactactctgtgctatttatacaactgaagaactgtataaactactttagagcagtggcctcattactgtcaggaacggaattaccaaatcaaagagacaacactgcgtattcgccatcactcacacactgacaaagtgcagtagtgttagacatcatgggctctgtcactgggaaagggacccagtgacttccacctctctgactctaaatagcagcagtcatattggcacctgtaccatatgattcaaagagaagattctacttccattggatgacagcttggaaacccggccatattacatagagcactacatcatttcacaagttgcgagaaaaataaggccactccgaggcaatctcttctgcctcccagggggatgggacacgggacagtgcaaagaccgtggaagatggcagtaagtagatgaaactccaggaccaaagggatgcagcctggccatggctgaaggtttttgctccattcagtagaaactggtgctctaattcattatcaaaaatgcttacttggtgtccacatggcacttgttttctcaggttaacatctgcctacagaaaactcaggcagaggggtgagggcagatgcctactagcataacacctggtttgcagcacgatacaggtggaatgacaagcccagagaatttcagacgaaaacatctggcctgagttgctacaaatgaagtgtgagagaaacgcggatacacaaagaaaaccaaactgcccgcccaccatgtttccccctccaacatacagctctttatggctaccccctattcttaattagaaaaatagtctcaatatgaaaaaaaaaaaaaaaaaaacagctgctggcactaaagtttgcaaactatggctcaaaaagtcttcctgcaggtaagtaaggaatgtcggcattcattttctcttctatgaagtttgcttggaagttagtcaccactaatctaaaccttgagaaagtgagctttcaaccatttctctcagctgcgacttgggtctgacttcccagttgcagtcacagaacctctcagcctgtttcagagaagcacttggaggagttatgtcagtggctctgggccccgtcccacacctcttggccgctcctccaccttagtgcaaattctgctccagaacctttgttctggtcacatggtggcactgttgcccctaaagcacggccaccagcaagacacagcagacaccatacaatactgactagcttgctccaaagaagaaaataaatagcttggttgaattataagttattttagagacaaggcttcataacttagtttttttttttttttaaaactaaaacatttggaggtaaagaatgtttctccttttgctttaggaagtgactaggtttctagaaatgctgtttctttttttttttcctacctcaggacagcctttgtcactgaggatttctagggttagggcttcacaggaagcgtctccttgaacccagagtggttgggttgggcttctggcagtgccaccgagtactcagttgtggcaaaaagcagggtgtccagggtggtctcagtacacttggcgatgaagcgaatgaaaggcctcacgtcgccctcgttggcagcttccaacacgtggtagtagtcggaccgctgctccttgcggatggtgatgggcgggtagcccgcctgcatgaggatgaggttcatgagcagacgggaggtcctcccgttgccatcaatgaaagggtggatgtaaacgagtttataatgggctaaggctgcaaactccactgggtgcaggttcatggcttcctcggagttgagccactgtacaaactcctgcatctgcttttccacatcctgcggatggggagggatgtggtgtccgaccaggacctgtgttgtccgaaacctgccggcttccacggggtccacgtagcccagcacccgcctgtggatctccagcacgtcgctgatggtgacggagccgatgcgcgaaaccagagtcgtgttgatgtacttcatggctgcatgcatgcctatgacctcgttctgctcctccaggctcttcccgggcacggcgtagcgggtctccaggatgtgcctgatttccgagagggtgagggtgttgccctcgatggccactgtgtggtagatgtgatggtagtaggtctcctccatgaccctgcgcagagctgagttccccttggggatggacatgaccttcttcactttgctgtcgatgatgctgaaatacctctggtcgatctcttccacaagaggcagtgtccgatcgcggttgaccagtgctttctcatggtagggtgagatggtcaatgctctggtgtacaagtagtccgcctggatgatgtccttgtcttcttccgagaagatgccaaactcggtgagcgcgtccacgaagtccgggtccatcttgagggcgtgcatgaagagcttttgggctttttcccgcttgccctggcgcttcatctccagggcctggttcagggcagctctggcttccaacttacccgctggaagagagccaaagaagcgctgtgagggagggaggctagggggcagaggacattcggggggctgtcccctgtgctggtctccgcaggaaaccatgatgaccagcctgtgtccctggccttgaggagcttgttgcagccgcatcgtgtgtactcaacatgcccggtaccactctgttgccccagccgtgtggtggtatgcagtcactatccgtgtgtccccagagccactctcttgtattctgggaggcacctccttggcttcctagcctcctgctttctggacatagaaagttctaggcatttacttcgcctgggccctctctgctgggcctttcctgtgggccacagctcccagtgtaggccgtctcctacatctccagctcatcttgtgctggtgacacaggttcctgccccgggaggcccaaaggcgttaacaactccccactcttcctagaccctgggggcgtcaaccatcccgggactgttctttaactcttttaacccagtggtttgattgtgcgccccaggggacatttggtgacgtctggagacctggttagttgtcataactgaggaggtggagggagtgctacaggcatctcatggggagaggccagggatgccaccaccatctaacaatgcactttcagtccccaccacagagaactggtggaggtggggagcctgctctagccctagccctcctgtcctggcccctcttggccacctgaggatcagccccacacattcaacttcctttagttcctcgaatgcccccaggctctcttacgacagttatgtcagttatgacaactaacctctggtctctgcctggagtccttttccttggatgcccttcaccctggatgactcctacttaacaactgggtcccagctcaggtgtcacttcctccagggagccttcctggtatgctcctacagccctttatgcttccccatcaccacacttgtgacactgtctcagtcacatcaccttgtctatactaggagctcagggctgacttgttcacaataccccgatgccccacatacaggacatgacacattctatgtctgtctatccagttaacaagcattgaggaagacggccagtctgtcttacctggagaggccttggtcttggccaccagcagcgtcgcgcccctggaggtgatgctgagctccgtggacgggctggtgcacttggtggcggcatgctgcgccctgtccggtttgctcctgagcaggtagaggcctttgagcacagccaagcactgctcctccacagcccccagcggcagcagcagggccagcagggaccccagcaccatgctcagcagcgtcacccagaggaagcggctccagaccgagacccatttcggttcagtcaccgccatcactgaagccattggtatgagcatcatctggactcaggagagggccctttgcgcatgtccacaggcggctgagagagagcaggatctgcaaggagccaagagtcgcaggagaaacagacacgttcaggacatagtgtgacttcagctgggaagatgggtttggagacttctgctcttttagctcactagagagatggggtgggggcaagtcaaggactggatctcactagaggaggggccagcctagaaggactggtgccacctcctgggcagtatgaatgtgaaaacactgctgtggtccaacaattaatgagcacttgccataatccaggccgtgtgctaagcaccaaatgcctcacatgggtcacctcctgcaatcttcaacgacttgagctgatgttttcacccttctccaggtgagggaactgaggttcagagaggtgaagtcccttgccgaaagtctcgccgggagcaagtgacagccttaggacttgaactcaggaaccccacggctctaaagtgtccccccttcccatatatccctgtggcttctgaccacaaacactggatttgtggacatatgtcaaacatttgggacataaatgactgacagacacccaggcagatcagccacagcagttctgacgcccaatctttgataagcacaattgttgggtggcctcatttattgccctcaccctgatattcagccacagctcccacagtgcccttcccctctctggccttccatttctggcctgtccagaagggaccccatcaagaagatgagcagttcgagcatctcgaaaggaactcaggctgtgggccacagtgcttggcctcagtgacaacatggcttgtatgtgcttggggctggcagtgggagtggaggtggggccaggcatgcaaacactatgctaacaataagcacttattaagcaactatggtgtcctaggtgctgagcagtgtactggccacgcattgcctcgtttcaccctcatgccaccctatgaaggaagagctaccgctagctccattttacagacaagggaaaccaagacacagagagcataagttaaattccagaaggcccacaggaggtaaacagaggcatccggaaggaaaccccagggcctctgaacccggtccccaggtctcgatttctaccttattactaagcagggcctgtgcacctgctctgggctggtcctgacccgggaatgactgatggatcacggggttctgagtctcatggggatcctggcccattgccacagaacatgtgaaatggcttggggtgcgctttaataggggtgcgcctggagtgctgcgcgggtccaggggtctgggcgggcttcccgaggggacaggctcctgggcggggcggtacaggaaagggggcagttcgccggtgccaggggtgtgtgcagggaaggagtgcgttctgggaggcgcgaatctctcccccacacttccctagaaagggagaactgaggcccggagaggggaggggaccggtctgagtcccctccaagactgcagagcctcccttcccgaaccccgcccagggctcgcggccccgtcgcacccttcccggcttcatcctctcgagcccctagggcttttccccttctcaccgcgcgcagctgtcagaaccccaaccgccttccccgcgctcccagctccgggccgccggctcccgggtcctcc

SEQ ID NO: 15009 - DNA, 33927 bp, Homo sapiens
agttgtctatcaacgtctatgactacaactgccatgtggacttgatcagactgctcaggctggaaggggagcttaccaaggtgaggatggcccgccagaagatgagtgaaatctttcccttgactgaaggtaagcttcagcagtcaggctgcttttagaaacagaaacaaggcttgcacattttttacaatgttgaaagtgggacatgctccttgtagaaaacctggaacgttcagtgtagtggaaagaagaaaacgcatcagagttagctatttttagtttattgtagttttttgcaaaatgtagttatgatcatataacacggattttgaattctgatttctttattctaacgttgtggtaaacatttgtaatgtaattaaacttggctttcatttctgtatttcccatttcactatttatgtatttaaaccattctcttgaaaccagaaaattgtaaatatatttaaacttttacagacagttttttatgtaaatgtttcatacattaattgttccagaatagttgggcatttaggttatttctacttatttgcttattagaaacataattgcactgaacaactctgtagttcaatcttcatgaatattaataagtgatctttgggcagtacttagaacactttggtcctagatcccactctgccccttttcccttctgcaaagcataactgccgagtgtagatgctggagtcaggtgacctagattcattcctggctacatcttttactagctgtgtgaccttaagcaaattatgtaaacattctaagactcagtttttctagcagttaaatgatggcaacagtagtttctgcattgtaatgtatgacggtataggatgagctattctacgtataacacttaacacatgcctggcatgttgtcatccttagatagatgtcattattattagtgttactatcaccaaccttacaggattgtgataaagactgaatgagaaaagtgctttgcaaaatataaaatgcctaacaggtggaggatattatgattttagtgatttgatcttatttggaagcataaaacctcctatgtgcttagttcaggttttaagaagtgaatttctggaaacaacgccaggttgtgtaagatggatgaaacgtttgcatgctgatgtctcttggtaaagtccctgcgcttagcctaccctttggtattaatgcgggaagtatttttgtctcgtagagctctggctggagtggctgcatgacgagatcagcatggcccaggatggcctggacagagagcacgtgtatgacctctttgagaaagccgtgaaggattacatttgtaagttcccgtggactttttttggatatctggcaatgtcatatatatcagtctgctgttgaggactgtattatgagatgttgctacccagaaaagggaacgttagtttcacaattagcaagatttaagttgagttgtcttatcattgtctttggtctttaattgaggaagtttaattttaaaataaaagtggaagaagcacttgtagtaagggaatgaatacactcacactcaggatttattgacagtgagaacttacatggtatttccactgatcttttatacattcaataggtttttagaggttttggacaggatgctttaaaaaaaaagattaaaacattaaaagaaaacctttttattttgaagtaattatagagtcataggaagttgcagaaatagtacagagaagtcttgtgtactcccttcacccagtttcctccaatatcttgtttctgtaatacaaaatcaaaaccaggaaattgaccttggaacaatgggaaaaaaaagacattttattacatgtgtagattcatctaaccactgctgcagtccagatacagagctgttctgtccccacagagacctccctcgcctgctggtattgacatcttaccagtgcaagtgaagtatagaagactcacctccctttaagtctctttaccgtcccttgtatatagtataattgtcttaaatattttctccatgtgaattggggaccacatcagacaatgctgtggacaaaatgcttttaaaaagcgttttaaggctgggtgtggtggctcacgcctgtaatcccagaactttgggagaccaaggctggtggatcacttgaggtcgggagttcaagaccagcctggccaacatggcaaaaccccgtctctgctaaaaatacaaaaattagccaggcatggtggcacgtacctgtaatctcagctactcaagaggctgaggcaggagaattgcttgaacctgggaagtggaggttgcagcgagttgaggttgtgctactacactctagcctgggcaacagagcaagattctgtctcaaaaaaaagcattttaaggccaggcatggtggcttatgcctataatcccagcagtttgggagactgaggcaggcggatcccttgagcccaggagttcgaaatcagcctgcccaacatggggaaaaccccatctccactaaaaatacaattagccgggcggggtggcatgcaggcctgtaatcccagctactcaggtggctgaggcatgaaaattgcttgaacccaggaggcggaggttgcagtgggccgagattgtgccactgtactccagccttggcgacaaagtgagactctgtctcaaaaaaaaaaaaaaaagcattaaaaaaatttcccctttcagactgggcatagtggctcacgcctgtaatcccagaactttgggaggctgaggcaggtatatcacgagttcaggagattgagaccatcctggctatcacggtgaaaccccatctctactaaaaatacaaaaaactagctaggcgtggtggcatgctcctgttgtcccagctacttgggaggctgaggcaggagaattgcttgaacccaggaggtagagggtgcagtgagccgtgatcatgcctctgcacgctagcctgggcgacagaacgagactgtgtctcaacaaacaaacaatttcccctttcagatttcgtaccctcttccttgttgatttcccaatgggagcagtccccctgtgagaagcattgctactaaccagatagactgttctgagatgatagagaattttttgtgtatctttacaagccaagaagaattcacagttttttggtttataatctgaataatgaaaataagcggtgttttatgaatataaaactatattatatgtgtgtttttttttttttttttgagagagagtcttactctttcgcttaggctggagtgcagtggtgtgatctcggctcactgcaacctcccccctacccaggttcaagcgattctcctgcctcagcctcctgagtagctgggactacaggtgcctgccacaacgcctggctaatttttctatttttagtagagacggggtttcaccatattggccaggctggtttcgatctcctgaccttgtggtcctcccacgtcagtctcccaaagtgctgggattacaggcgtgagccaccgcacctggccaaatgtgtttttaaaaactatacctgtatctctgctctgtggcccatgagtcttcttttagagccactgataattttagcagtgcatggtgttcccatgatttctgatgatcctgttacccccttcttactctctcacaggcattgttaatagcaccatttatctttttctgaggatctatggtcttccccagactgtaatgttttttagtcctttatggtcatctctgctgttaggccttcactgtcatttagtgctgctgtctgagtacttttttggtaggcacatttcgtttgttatgcatcagttttgatatttgggtattttatatcccaaactaattgaacacttcttatttttaggtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcgggtgagtacctgtggttgtctctgaacgggttggggctgtctttgtaagtctccttggaaggattattttgaaacacatgtccatgatgaatcttgcagttcatatagttaacaaaatggtctttgccaatcccttagtggtggggtgatagataacctttttttataccccttctagcatttggtacaatatgtatggaagaggtcgtataaatttttttagcttgaactgaaaatttgttgagatattttttgaagtagaaagaaccagagttggccaagtgcggtggctcatgcttgtaattccagcagtttgggaggctgaggccagaggatcacttgagttcaggagtacaagaccagcctgggcaatgtagtgagtccccatctctacaagaactaaaacattagctgggcatgatggcgtatgcctgtggtcctagctactcaggactctgaggtgggaggattgcatgagcctggagtgtgaggctgtagtgagttgtgatcacaccaccacactccagccagggtgacagcaagaacccttctcaaaagaaaaagaaagaaccacagtttgtcatttactactaatttgcttctttagcccgtagctggcttcctttccccttttgaccgggaacaaacctttgattcacagcttgagaaagtccacagtcttttccggcgacagttggcgatcccactctatggtaagagaaactgacatgtcaacagccagccctctatggtttttaaaatgctttggggaacaacatgtagttagacctttcccaccatcctgtgaggcaggtaaagctggtgttcttactctccttggatattgtctctttggatgaggtccttggtaaaaacatcttgaatgttagtgcttaagagggttgtgagggtcagaggcaggactggaagccagactccctgactcccaggtgagagctcttttctcctttgagacctagttggaagggcagagatagggtctctgaaaggaatagtgaatgacacctgtattttttggggaaacttcattgaacaagagttccattataatcattttctcttcacaagtaacctcttccataacagcaggaattttacatgagtttagatcattcctctatgggagggatttggttcagaagtgcagttgattggaagtactcataagtgagtttcttggggtttggtaaagagtttccttatttggtaaatacattttggcaatctaagcctttgagtctttggagctatgagtgtgtgcgtgctgggaggatttttctgagtatgggaagagtttgtcatggctgttgtgtttgttccctagacacgggcatgtgttgtacatactcagaacctctgggcaactttactggagcccacatgttatttctcttcatggtttattggatttaacaagttataaagtagtcgtctaatcaaatggttgggtatcatgcagaaaacactagagctgagccggcttgcagatttcacctaccagcgtgaaacaacctagcataatgattagagtgcgaacttgagccagactgcttgggttcacagccttgctctaccattaactgtagacgagcaactgaaccctctgcttcagtttcctcaactgcaaaatgaggatcacaatagactaccttgtagagtgggatgactgaatgagttagtggatgtgaagtggtagaacataggtaacactgggtaagtgttgttaaatcgttgccactagtgtcattgactgattaattagctgggagggttgcctgggacattgttttaagacagattctacagacaggtttgggctcagcagaaatcagaatttgatcagtaagagctgccatgccacagatgtgggaggggctagtggcacctgagtctcatggcttaatctgtgtttgggttgataaagcccaatggcaagacccacggggctgaatccatctttcaatagatatggaggccacatttgcagagtatgaagaatggtcagaagacccaataccagagtcagtaattcagaactataacaaagcactacagcagctggagaaatataaaccctatgaagaagcactggtaagtgttggcttcttttatagtaaacgtctctctacaaacctttccctgatggatagttgcgagttaaacagtatctttaaaatgttttattctgaaatatatagagtgtataaatgtatacgtacagtttacatactaataataaagtgaacatccatgtacctaccacccaggttaagaaatagaacattgccagtaccttagaagtctcctatgtgcccctctccgattgcctcctcctccctctcccgagaggtaatcactttcctgacttttgtgatgataattcccttgcttttctttatagttttacaagctatgaaagtatccttaattaatatattgtttaattttgcttgcttttgaacttttatatattggaatcatgctgtatattttattttcattgaacatgcttttgggttttactcatgttgctaagtataactccggtgcatttgttttcactgctgtaaagttgtctgtgtactgcgatgtatttatccatgttgctggatagttgggtcatttccaggtttttgctaggagaaggagcagcgccactctgaacattcttgtgtgtatctccttgtacacatgaaaaagagtttctctagaatacgtacttaggaatgactttgctggatcatagggtgatgttaaagtgttttccaggttatcagtttgcactgctgtgagcagtatctgagagttctcgttgcttgtgccaatcttggatattggtcatacttaaattttacttaatttgatgaatttgaaattgtagttttaatttgtattttcttggttactaatgaagttgagcatcttttcacgtggattggccattcaaatttttgtgcgtgttaaagtgttcaggctgggcacagtggcttatgcctataatcccagcactttgggaggccaaggcgggaggattgctggagcccaggagtttgagatcagcctggcagcgtagcacaaccctgtctctaccaaaaaaaaaaaaaaaaaaaaaaaaaaaaagccgggcttggtggcatgtgtctgtagtcccagcttctccagaggcgaaggtaggaggattgtttgagcccaggaggtcaaggctgcagtgagctgtaatcatgccactgcattgtcacctaagtgacaaagcaaaaccctatttcttaaaaaaaagtctgggccgggcggggtggctcatgcctgtaatcccagcactttcggagcccaaggcaggtgaatcatgaggtcaggagtttgagaccagcctggccaacatagtgaaaccccgtctctactaaaaatacaaaaaattagctgggcatggtggcgggcgcctgtaatcccagctgtttgggaggctgaggcaggggaatcgcttgaagccgggaggtggaggttgctgtgagccgagatcgcaccactgcactccatccagcctgggcaacagtgtgagactccgtctcaaaaaaaaaagtctttgacccatttcccttttgatgtatcttttttctaattgatttgtgggagtgctttgtcttaagtcttattttaggctgtatgtgttgcagattttctccccagttgtttgtcttttcacttctttttttttgagactggagtttcgctttcacccaggctggagtgaagtggcgtgatctcggctcactgcaacttccgccccgccaggttcaagcgattctcctgcctcagcctcccaattagctgggattataggcccttgtcaccaagccccgctaatttttgtatttttagtagagacggggtttcgccatgttggccaggctggtctcatactcctgacctcaggtgattcacctgcctcagcctcccaaagggctgggattacaggcgtgagtcactgcaactgccttttcacttttttattttttaacagtgtcttttgatgaacagttcttagtgatcaattagattaaaattctttcccttttggttgtgcttttgttgtgcttatttaaaaaatattccctacttagctctaatttcttctaaaagttttatagttttctgtttcatatttaggccctcatccacctgggattgatttttgagtggtatgagactgcgtctggtttcatttttccatatggagaaccagttgttctagtactgagtttgatcattccttcttcccctcactgatgtgcagtgccacatctgtcatagattagctgtccatttatgtgtgggtctttcttctggattttctgttctgtcccactggtttatgttacactgttgtaatgatgagagttataatgttttgctcttggatagggtgagtcccatccacctttttcctcttcaagaggatcttggctttttttttttttttgccttcaatgcttccatcggatttagaatcagcttttctagttatatttttaaaatctttttttttttaattggaattgcattgaacctggagatcaatttggggaataatttacatcttccaatctatgaacatatataggtttctgctacttatatcttgtctttctgtaaagctttataataatattataaatttgtccagtgtcttcaacacttgacctttagagtcccctgcaagggagatttgctggtaacagattttctgtgttcaaaaaggtctttgcttcccttcttgaaaattattttcttaggctatagaattctagaccgacaacagcaaaagaattctagacggacaatgtgtcctctcagcaattgattgtatctttctgtcttctgatgtctgttgttgctgttgagaagtcagcggtttgtataaatcttgcttcttcagaggtagtcacttttttgtctgactgcttttaagatctcattgatttggtttgctgtcctctaatttcactgcagtaggtccatgtgtggactggcttgaagttttttgggcttcttgactctttttttctatctttctttgccaacaataggattgtgaaggtcagattcttaatatacgtcaagccagcaaaaggttaatgtttacttagcttgccaccctcatttagattttgtccttagtccttagtatttcttgtttctttgccagtttgttgatgacttttaagaagatattatatttaatttagcagttttagttgttttgaatggtacagtgtgtctgggtaactaattcttcctcgttactggaaatggaggccctgaaacatcccctttctacatatggagtctgtgtgttctcttactctcctgcactgcttcatcctttctttttcatgtgtaaatgatttgcatgtacctgtgcttcccaaaacttcgatcattcaattatgtcatggccatcagcaaaatgtgcctgaagagaaaacatgtcgaataagatttttttctaaaaagaatttgattgtatgtctttggatcattaaacattcagcacagctgccttcatcttctgcatttatctacattcttccaggaactgatatttggaataagaaacctgaaatagcatcaggcaccaaaattttccagtttggttgtattaactctactcagtagcccaagaacatgacttctggtttggaagggtggttgacagtggtcactggcaaaggtgttgctctttcactcagttcctgattgatgggctacttaattccctgtggtctaggaatggatttagaaaagagtttatggagcctttgtagcgactgccatgaactggcactttggaccagatgagaagactcttgttttgctcaagaagttgtagaggccatagtggagtggttctgagagtgaggatttggcgattcatagttactgtagccagttttgccaaaatttattttatttgcagatgtgttgtgcttcctgccagtaactaaattcaatacaattttcctgtactccagttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagtaagatcactgttctaatttcattttatttttgccaatttagaatctacttaaaatcagtaagagtgccaggagtttgttgcatacggccctactcttgcttttcctccatctgctttttctcctctttgccaactcgtttagaaagttttagtgtttcaagttatttaaaaatggtcactaactgtaagtaaaatgagcatattgtctgtgttgaggacttataacaacttgatatttttcttttaactttttattatggcaaaaatgtaaacatataaaagtagacagatcagtaaaatgaaacttctgtacccctcacccagcttcaacaattagtaacatttatagctttagtttactttgatctgtagtctcacctacttgtcccttctgtgttactttgaagcaaatccagaaatgatatttcgttggtaaatatttcagtatgtgtatataaaatatttcagtgtgtctgtataaaaggatccaaatgaggtctatccagtagggttggctgacgtcttttaaggctgttttaacctgtaagttgctcctctccttctcctccactccccttagtgatttttttgttgttgttgaggaaaccaggtcacaagagatgtttataaggacatttctttcatcacttggtcgtgctggcaatgtcttgttgatggtgaatgcttaataaagtgtaatttcctaactctggaattctttatcataggatcgacaactgaaagtaaaggatttggttttatctgtacataaccgcgctattagaaactgcccctggacagttgccttatggagtcggtacctcttggccatggagagacatggagttgatcatcaagtaatttctggtgcggatgtttttgtgggagaacttctaagctatttgtcccaagtgaaaaacagagagcggtgacaaagtcattacatcagtgttccctggggttttctttgggttatggagtgtagtgacaaaaagggctctgagtgagagatgaactggttatatttgtggcttcttagagctttttaacatgctaatattcattgtattttctaagaagttgtagtgttttctccaaacttccttgatctggaacttttcttgcagggcgtcttgtggaagaagttttttctagaacacagtctgtagagtgctgtagcaacttctgtcttcaacattcctgtctagctcatttcattctgttgcatctattagtctttaaagtcatgtagtgttttatagtcagtagaatgtagtgactttctattagtttccatttgaattggtaacaaatcctgacttttctccaactccagtaaccttcgagaaagctttgaatgccggcttcatccaggccactgattatgtggagatttggcaggcataccttgattacctgaggagaagggttgatttcaaacaaggtatttaagcacatgtttttcactttagagctgaacatgttcttaatacaacttttggcgagatgtcccagttccccagatacattgtgattgggcaaatgatgtagactaggtattggtgactttttcccccagaaatcttagcaatttctgtctttaacaagtcatgatgtggattgtaaagcaagagagtaatcgtttatactggctcctgccagcctttttagtcttagctctcatttctcctttcaggtctttttatttatcctaaatacttcttgaaataagtctgctgtgttttagaaaaatctttgtacctctgtgggatcctttgccccttcatgtccccccgaaaacaaccagaaaacccctaacttgtacttgcacactcatgtcagctgtcacctcatacaggtagcctttagccattctcttgtttgcctgtgtcaccccagctgggggagactcccccccacagcaccctgtgtttgcctttttcaccacgctgtccatgctctattctgttcaaatttctttctccccaactatgtgatgagggcaggaattggcaattttatttctgtgtcccttgcatgatgccaggtacatagtgggtctccaggcagtttcagcataggataaaaaataaaacaaagccaggctatgtggtttcctaaagcctttttttgcactttccgttagactccagtaaagagctggaggagttgagggccgcctttactcgtgccttggagtatctgaagcaggaggtggaagagcgtaagtatgccccagcctgtggttttgcccagttgtatttccttgtctgtactatttcctggttgatgtaccttttcagccagcgactatctgtctccaagttcctttctaattttactaattctgtttttgaaggtttcaatgagagtggtgatccaagctgcgtgattatgcagaactgggctaggattgaggtaaatgtttttgacacatctagcactttcatccatcattgtttaatagcatcctattaaactttaattaaaattgagtcagaatcccagataatggcctaagctctataaggatttatgttattacctaggtaatggtctaggctccacaaggattcatgttatttacctagcttgacatatatttgtaaatatgttggtgaaaatattagctcccagctagaagttgtgcagtaaatgtttagatgctaggtattcactcgtttacttctgtctctgcctctttgcttcatttgtgagagcacagtgagcgtgtactgtttgtcagcactgtactaggtgctgtgggaataagacagataaaattcctttgctagtaaggcttctatctaatgtagaagacagatgatttgacaagtaattagaggatatgatgacttgaatgtcattactgggtcagggacaccaaggtcagtaagacacggaacctcccttgatcagcaggtaggattgtaacaattctaatcatgttttctcctcggagggagcgtcagatagaagaaactaacatttgtcaggtagtttttatatgggatgcttatcttttaaccattttaaagatgagaaaactgagaattacaggttaagtaatttgcccaagtcacagtttgtaagtattagtagcagagtgtgcatttaatactagatcagtcttttttttttttttaacattgtctctcaaacacttgtagttaagcttgataaaaataaaaaacgtgactatctagtactgtcgagtaagtaccgtgcgctccctctctcggttctcaggaaacataggtagattagcttgtggctgcagaaaggctcaagtgtttgggctgggtcgtttaccactggagggaggcctggggaatgcccagggacatctgtaacactaatagttgtggggtgctttttatgtgtgtctgttggaagtgtgttgtatgatgggtgtcgacgtcataaggttcaggtctcctaacagcctgctgatgcactttaggctcgactgtgcaataacatgcagaaagctcgggaactctgggatagcatcatgaccagaggaaatgccaagtacgccaacatgtggctagagtattacaacctggaaaggtaactgatctcggggtggggagggaggcagtgcttgtcagctgtgcacctgtcttcactcctggctgactcctaccagcttggactagctccttagaactgggctgttttctttcattctgtctctttcagtagtgggtacatttttaatgggcagggctagagaaccagacatgatattttgtgcctggaactcttatagccatgcatttcttttaatttgtttttgtcttgatttttgggcatgatattttatttgaccttttggagctatttgttttttatatttgcttttatagaaaagtagaaaatactaaaaagctaagagaaaaaaaactcaaattactgacccagtcataaccatgacccattctttgagacttttctatgtttaaatttttttgtaatgaaaatgcaattatagcatgcatgtgttacaagcctttaaaactatttgaacgaaataagataggcctaacaatatttataacatggggaaaacataaagaatgtgaccaacttttcagtctgtcttgaacgttgttcattgcataacattgctacattgctgggttttcttttttgaagattttttccctatttaaaaaacactgtgtgcccaaattagaatatttacaaaaatatgtgatagaaagcgacagtttcttttcttttttcgggggaggtggggagtctcactctgttgcccaggctgaagtgcagtggtgcagtctcagctgcaaccttgcctcctgggttcgagcaattcttctgcctcagcctcttgagtagctgggattacaggcgtgcaccaccacacctggctaatttttggatttttttttttttttagaagaggcacagtttcaccatgtaggtcatgctgacctcaagtgatcctcctacctcggcctcccaaagtgtaggaattacaggcatgagccaccatatccggctaaacgtgacagtttcttacaatcccaccccagagataaccactgttaaagcttgttgaatatccccctagatctgcagttcacaatttttttggtctcaggatccattttccactcttaaaattggaggatcccaaaaaacttttatgtatgtgagttatatctattgatatttataatttataaattgagaaatctaaaaaacattttaatttatttaaatataacaaattatctaacattaatatcttttttgagcagtgactgttttccagaccccaaaataatatagtgagaaaagtggcagtgttttctatttttgcaaatatatttatttgcacattattctgacctaggagaagacagctaaattctcatgtctgttactgattctgtctgttgtgatctgttgttttcattgaagaggttaggaaagaaaggtattttagaagcattttcagataattgtgggtattcttctttcatacatattatagcaaaacttcagtgttgcatgtggaatctgaaaccatattgacagagtctgttacagtaatacccatttgtctattttatcttttacttgatgccacaattctacgacattatttggaaaaatcccaattcactaaatcatgcagctcttccaatgttgacatatttcatcctatagtattaaaaaatcgtatttgttcatatctgtattgatcttagttgaaaagtattttaagtaggaagctgtcagacttgtggtggcagatacaagttttccaaaattctaattttcacttgaaagcttgaattctatcacatgcaacaaataatgtcagtggttttccccagagtggcagcctcactttgttaattttcaaaaatgtctgccaaatacccaggtctgagtaactgaccgtggtttgtcactcaagtttcctttcaagtaaaaatggtgtccttgaaaaaaatgacttgattagcttgcaactcaaacagtaatatgcttttttttttttttttggcaataaccattgtacttcagtatgcagaagggctttaagtgtacttagtatttcatcacacagtgcattaaaaagatttctactgccttgatttgtgctaagggccaccattacttgtgcactgtcttgaagatgtcaacacagtgaaaaagtccagtaatgtcttggtattattataaaaggagttttgactttgcagggcccctgagaggctctgggagatcctcaggggtacgtggatcttactttgagaaccagtgctctgaatttattctgagcatcataatatgtatatataattatgtatatttaaaatgttttaaaaacaaatatgaatacactgttgcataacagttatgattagcagaattgtgtagctgttgtgattagcagtgtacaaaaaggatctgtttgcgaccagccttgccaacctggtgaaaacctgtctctattagaaatacaaaaattagctgggtgtagtggtgggcacctgtaatcccagctactcaggaggctgaagcaggagaattgcctgaacctgggagacagaggttggagtgagccgagatcgtgctattgcactcccacctgggtgacaagagcgagactccctttcaaaaaaaaaaaaaagatctgactctgggtatgaaatttgacactaccctggattcataactctcctgtcagtaggacgccatagtaaaatttccctggggactgtatcaggttacagagagctgttggactcccccgccatgtgccgcacatgtgaatgctgtaaaggcagaatgctggttgcagatcacaatatcaggtacactttccagtagcccctacatggctgagggagagagtgcttcagggaaatacttcgtaggtgactgtagagactctggaaggagaaagcatcatggatagatctgaaagctaaggtcttctcagaagctagagttactgaagagtgagtttctacctgggagaagacggcctctcccttcgagtgccttccactttgtgtcctggtggcagcaactttttgttttctgccttagagctcatggtgacacccagcactgccggaaggctctgcaccgggccgtccagtgcaccagtgactacccagagcacgtctgcgaagtgttactcaccatggagaggacagaaggtgggacccccagctctcttctggcttggagcctaacccatttgctgtttggtctcaagtaggagcatctggttacagtctggggacagactgtgtttatgctgccaccttaggtggtgccctatgattagactgtcacaagtgtcctgaaaatgagtcctcctgcagctcttctcaaattctgcagctacaaggaggactctgtgatgtcactgtagcacagggttctaattctctgtgggggggactgtgcgttatacaatgtttaggggcatccctggcttctagccctgaaatgccagtagcagcttcaccaccacaaccaaacatgacaaccagaaatgtctcttaacattgccaaatgtctcttgatgggcaggatccctcctttgagagtcactgtgctctagtacaacatctatccaacaaaggagcttggagaggcaaatggctcaatgtgtcctttgcatcccttgttaaatttcagagccttcagtgttagctagaaccaatagaaaaataatgtgaacttatctgtgggtattggtctggattttgggtatggacccctcagaactggcttgcaaagaccaccaaaaaataagaaataaatgcctcaacatttgagtagctcttaaaattcttcagtcttaatataaatgtacttttgcattagaacgttcgttttcatattcttgccatttagagcccttaatagatcatattctggttttcaagtctctcctgaaaggagagggacattttaaacccacttagaaggactatttgaattctgaacttcaagcctacagggattacattttcttattgtttgatgggagagatctcttctggaggtacagagaaattaagaaaaatttatgtgattgtatccttcaaaatcctaaagagtgaaagttttgcttctctttctttcaaggttctttagaagattgggatatagctgttcagaaaactgaaacccgattagctcgtgtcaatgagcagagaatgaaggtaatgacaatgtttgaagtctttggcacctctggtagctattttggctcagtttggtatggatgtttcttgtcaagatgttttacattttcctaagtgtcttttactcagtattaattataaaatatttagatcaatgcttaaacctgtcttgtgtcatttttacattgttctaaaacatcagccccaatattaagtacttgtttcatttagtgagggaattttggctctaaaatttacgagaattgatgaaaaagaataaagaagagcctcacttagcctagtgagtggaacatgaacaccccaacttatttagggcttcagttttatggatttttttttttttgagacggagtctcgctctgttgcccaggctggagtgcagtggcatgatctcggctcactgcaagctctgcctcccgggttcacgccattcttctgcctcagcttctcgagtagctgggactacaggtgcccgctaccacacctagctaattttttgtatttttttagtagagatggggtttcaccatgttagctaggatggtctcgatctcctgacctcgtgatccacccatctcggcctcccaaagtgctgggattacaggcgtgagccaccgcgcccggccagttttatggatttttttgccttccttttggtgagtaatgattagggtgaggaaattgctaatgtaacagagacatcagatccagaattccaacgaacctgaatgagccctggtgtggaacagccgtgagcctgtccacgtttttctcctgatctctgcttttcattagtaatgaatttccactccttctcccctttcatgacaaatcagtacagtgaatgtaattgccacatccagcgatgcatcatcttcccacttttctaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaaggtaaggagctcttgagaaattgtgttttgaaacgtcttaaagttagagaagttgcgaatacagtatgaagaactttcttccctgaaccgttaccagcttgatacccattaccctttgatcactgttagggtgtatgtcttgcaaacaaggggccctcttctacatgactagaatgcagccatcagagccggggttagcaatgagctatgggttcccatttatcctgataatgtcctttgtagtgaaaggatccggttcaggatgcactattgtgtttagttgtcctgtctcctggatctccttgagtctggagcactcctcagctttttttttttactctgatgacctgcagtcttgtaagggggcaggccagttgctgtgttgtgcccctcagcctgggtgtgtctgatgctccctaagcattggattccactcatgcatctcgggcaggaatagtgcacaagtgctcctgtggcctgcccattgagtcccatcaggtggactgtgattcgctttgttccatcactggtgatgacccttttgagaattatttatgctgattctctacttatcccaggtttggctagcaagagttccttcacacaggcttctatgtccctttgacctgtccccttgttctttgatcatttccttaccttctagcacacaatacccaagggtcatcttatactttccataactcagccctggaatccatcatttctccaaggttcctttgagtgatgagtggtatttagaaggtgctagttgtgctcactgctgttggttattgttctgaggcctgagtggtcgagggtagggagtgtgtgtgtgtgtgcgtgtgcgtgtgcatgtgtacacatatttatgaccatatttacttgtgtaactatttgtatatactgaaagtcatgatttcacaccaatacctccagttccggtctaacaccacagggttccccttcacacttgcaatgcccttctctctctttttaaaatttatttattcatttatttttgagacagagtctcgctttgttgcccaggctggagtgcagtggggtgatcttggctcacttcaacctccgcttcccgggttcaagtgattcttgtgcctcagcctctcaagtagctgggattacaggcatgcaccatcatacctggctaattttttgtatttttagtagagatcaggtttcgccatgttggccaggctggtcttgaacttgtggcctcaagtgatctgtctgcctcggcctcccaaagtgctgggattacaggtgtgagccactgtgcccagctgtgtcacgcccttctctgaccttgagaaacttggctccctctattctcagcatcctcagttactccacccggcccctgtaggtatgtaatcaacttcctgtgcctgcctccccttctcatatgtgccatccccaccctgtttggtctcccacacccggggccaggcacggccctgcatggacacccttgcttctttcactcaggcttccagatctaggctgctgggtccctgtcactgccccatgcctgcctgtcttcttccttccattcaggctctagcatcccgcaccactgctgcagccccaaccctgcacagacctgccaggcttggccctacttttttttttttttttttttgagagggagtctcgctctgtcgcccaggctggagtgcagttgcgtgatctcggctcactgcaacctccgcctcctgggttcaagtgattctcttccttcagccttccaagtagctgggattacactttgccagccaccatgcccagctaatttttgtattttagtagagacggggtttcaccatgttagccaggctggtcttgaactcctgacctcaagtgatcctcccgccttggcctcccaaagtgctgttattacaggcatgagacactgcacctggccttggccctgcttttaatggttctgacttagtggaattttccagcagtgtttctttcacccttgtaatttcagggacgggcagctctgggtcatatttatttcagagagtcagtcaaggtaaagaattgtctctggtggctgggcgcggtagctcatgcctgtaatcccagcactctgggaggctgaggtgggcggatcacctgaggtcaggggtcaagatcaacctggccaacatggtgaaaacctgcctctactaaaaatacaaaaattagttggctgtggtggcgggtgcctgttttcccagctactcgggaggctgagacaggagaattacttgagcccgggaggcagaggttgcaatgagtagagatcatgccgttgcactccagcctgggagagagagcaagacactgtctcaaaaacaaaacaaaacaaaaaaaagaattgtctctggacttgaaaggactctgtatactttcttaatacagatgtgtgagccagagagaactgggaatggagtcatccatcgttgagttgaccttgcttgcacaccttgtttgggctttcctaaatgactgaggatggctcattgctccactggcctcccagtttggcagaataaggcaaatgtgatgtgtgaccgcagtggtgtgtgatcagggcatggcgtgtgatcaggactgtgggagatggcattgttaatactggtggaggccaaagaaggcactagtgggtcaacttcgtaccaggaagactgtgggggaagagatgcggcatccagggggaagaccgagtgactgtggcagcgagaagggaaggtctgagctacacagggaggagccaatgttagtacagcctgaaggcacagcacagcctggcattttctgtgagcagcagataattgggtttgaactcagatgcattagagaggggtggggcagtggtcgaggaggctggagtggtaggtgggccagtcagctggacccagcccagggacactcttgaatacagtagcagtgtgcagggcttacgttgcattggaaaggcagcgggtgaactgatggggaggtctgtttgccggaggctgatgtctgttgagcttcagtactggccctctggaggcagtggtgaggacagactgcagtagaagattgtggttaagctctcttaaggacacaaggccatattgaaagtgttttagaaaccacagatcctttgtagtgctttccaaaatgtgctccctggggcacgggtatcagtcactagggtgcttttccagtgcagattctcatgtcctatcccaaccctgctgatctgggctttgtaggagaggggccctggaatttgccttctgaactttgagatccactgaccttttgtataattaagagtggacaatggggatttatgttattacttccacttgattgagcccacttacccgagtgtaattggggcacagaaagtcgtgggacaggtcaggcggatcacaaaagacttctcggggtggtgcttgcccctccgagtctggtgagggagtaagtgtcacatgcagctgtcacagcactttcacttcacacctctgttcaagctccctgaagagaagtaacagttaaccatggctacttttcttttgaaaacctgtagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtaggtttatggaaaaaaagaatgcctttcatctgtggttgctttagacaggcactttcttcctgcagcagtgatatttaggatagacatggaagttttacgctctgtttggatctaaacttccttgtgagccaaggtccatcctgagccggttgactgaggtctgactcatggcatggctccttcttgctgggtgcttagcaatgacaagggactgtgctgaatgctttatgtgtgtcagctcattgactcctcatgagactctgtgaatggttacttttattcttgccgttttacagaggaagacatggaggcctggagaggttaagtgactcgctccggtggccccattaacaagtttcagagcatggcttggctctagtctgcctggctgggctgctcatggggacaaggctggtgtcagaggagtcaggtgagctgggtcatgcctcgaatcatggtttttctctgtcttccttcttcctataggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaaggtcagagtcagagcagattgtgccttgtcttcaaggcttgggcaaacttcgtttctgtatcggttcaaagatgatttaacctctagaatgggttcctagtttgtctgctgagaaacaaaagttaatttcacagaaagatctgcacttagctctacttatatttggagtcagattaacctgtttgtagttaattgtactaaaaagaataagacacttggaaatagaggatcatgaattcaccacactatggcccctggctgtggggcttgggggaagccctgtgaccagcagcatacgggctttggggtgggcgccctcctgcagccttctccctctgtcccaggcctctctttctctggggcctccaaccaggccccttgagtccctccattgcagtgcctcttctcctgtctttccttcttgccccctcagtctcctgctaagtccttttgtgccccattttgagtagtaagtggtttcattactgtctacccactgcccactctccctcccctttatccaggttaatggagagaaaaagaggatgaaatgagggagcgggtgaaggcacagaaacacgagggctcacctgggcacctgggctgctggccctgtgtcccatccacctcttggtttatttgctggatttatactggtccatctgtctttttccttctttctttctacttctgcagcacgtacaaggtgtgctgaacttggaagggttatctgaagttacagtgcatagcagcactcgggaaggagagtagggtggggaaataagcctgtagacagaggatgcggtggtggggaaggtaacctgttggtgggtcgtttgctgtggcctggtctgctggtctccgggaggaagcccagtgcctgccctgcaggaggaggttgcgtccctagtctgcgggatctgacttggttctggatcttgcctcttccagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgtaagtgcttgcatggtagactagtgcaaacttcgtcctggctggcaccagttcatggatcacggggggattaacccgggatgaattagcttcctgttaggacagaaaagccaagatgtgctgttccttgtggtaatcactgtggttccactggagcaaggcgtccagagcaggatgcaagcctaggcagtgacctctgcctggtactggccaatttacacttgtcatttatttcagacagaaataaggcagtgattattttaaagtcccctttgccagttggatctgtgtgtttacaaagaaatctcatacccatgtgtgtgccagtctacggccctagctatgatccacataagctgtgctgttcgctggtttgggatgaggaggagatagcagaattgccaggtgactggtgaggtctgagaggtgatagtcacactgatcccctctgagtgtgactggtgctcagggttgatctttgccaaaactgaacaaggccaagtctgttgaagcagtttttacttcataaacagaattaaggaggcagggattatcttatcctttttttttttcaccttttaacttctggttatattaaaactgtcttggcttattttcacaaataaatgaggggccacgaattgttgcttcaaaaggtccattcagtgtttgctcttttaggagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagccattgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccattcagcttccagcattcctcaactcccagcccctcttccttcatgtctgtttcccctccaccctctgttatattgaggcacgttccagatgtcattgtgctcatccagtaatgttgcggcaggtgtctcaggaggactgaaaggccttcactcctagaaacattagtggtaatcccttcatgtcatcaactgtccactcaaatttccaccttcctacaaatatcagctctcctccctgtaaattattggttggtaagcctcttaagtcttaaaaggtaggttcccctccatctcttttttatacaaaaccaactttttactaggctttacttctgaattaaattcaagcggcggctattgacagcagcaagaacctttgctgtcccacgcgttcctcctgcagtgttctctgtgatgctgcttggaaggctgatggactgttcagctggtgtgatgatttgggtagctcagagccctcatggttggggacctgacacatgaagagccctgaatatcactatgggtgagtgtggccttactttttgctgcttcacattaacggtttggctttgcctgcagccagtattctgaccttaatgtcacacttgcagatgtcagcccaggcttggtacaggggcaaaccttttcaggcttgagcagaacccagttaggttccgggtgttgactgttctagaaatggatttccaggactacatgagtgggtttgtgtgttttccccagaaaatccagaactgatgataaatagaaatgtgaaaaactacttcagttacttgactgtttgttagtaaaaaaaaatcagtaattcatccttgcccacctaggtaggcggtttatccaacttctgggtctcttgcccatggaaatcaccatcttggatctgttgctctcccagaacagtattatgaatagggctaaaggtcagaatacccccactgcccttatgacagatgggaacatctcccaaataagacagtctcaagcattcatgtaataaaataactttattagaatcaggaatttgttaaaataatatccttcacatatagctaaagtgcaaattctcttgctctgtagtagaagcaagcacatctgtcagacctccgtggtgtgcttataaaaccaagacgagaagagttttaagaagtacctctggcagcataagagtacgaaaacacattttataaaggtttgaacaattatcatttggagccatttcatatatcgtgtatgtcttttcacttatttttcttaacctttcaaaaactactctgtgctatttatacaactgaagaactgtataaactactttagagcagtggcctcattactgtcaggaacggaattaccaaatcaaagagacaacactgcgtattcgccatcactcacacactgacaaagtgcagtagtgttagacatcatgggctctgtcactgggaaagggacccagtgacttccacctctctgactctaaatagcagcagtcatattggcacctgtaccatatgattcaaagagaagattctacttccattggatgacagcttggaaacccggccatattacatagagcactacatcatttcacaagttgcgagaaaaataaggccactccgaggcaatctcttctgcctcccagggggatgggacacgggacagtgcaaagaccgtggaagatggcagtaagtagatgaaactccaggaccaaagggatgcagcctggccatggctgaaggtttttgctccattcagtagaaactggtgctctaattcattatcaaaaatgcttacttggtgtccacatggcacttgttttctcaggttaacatctgcctacagaaaactcaggcagaggggtgagggcagatgcctactagcataacacctggtttgcagcacgatacaggtggaatgacaagcccagagaatttcagacgaaaacatctggcctgagttgctacaaatgaagtgtgagagaaacgcggatacacaaagaaaaccaaactgcccgcccaccatgtttccccctccaacatacagctctttatggctaccccctattcttaattagaaaaatagtctcaatatgaaaaaaaaaaaaaaaaaaacagctgctggcactaaagtttgcaaactatggctcaaaaagtcttcctgcaggtaagtaaggaatgtcggcattcattttctcttctatgaagtttgcttggaagttagtcaccactaatctaaaccttgagaaagtgagctttcaaccatttctctcagctgcgacttgggtctgacttcccagttgcagtcacagaacctctcagcctgtttcagagaagcacttggaggagttatgtcagtggctctgggccccgtcccacacctcttggccgctcctccaccttagtgcaaattctgctccagaacctttgttctggtcacatggtggcactgttgcccctaaagcacggccaccagcaagacacagcagacaccatacaatactgactagcttgctccaaagaagaaaataaatagcttggttgaattataagttattttagagacaaggcttcataacttagtttttttttttttttaaaactaaaacatttggaggtaaagaatgtttctccttttgctttaggaagtgactaggtttctagaaatgctgtttctttttttttttcctacctcaggacagcctttgtcactgaggatttctagggttagggcttcacaggaagcgtctccttgaacccagagtggttgggttgggcttctggcagtgccaccgagtactcagttgtggcaaaaagcagggtgtccagggtggtctcagtacacttggcgatgaagcgaatgaaaggcctcacgtcgccctcgttggcagcttccaacacgtggtagtagtcggaccgctgctccttgcggatggtgatgggcgggtagcccgcctgcatgaggatgaggttcatgagcagacgggaggtcctcccgttgccatcaatgaaagggtggatgtaaacgagtttataatgggctaaggctgcaaactccactgggtgcaggttcatggcttcctcggagttgagccactgtacaaactcctgcatctgcttttccacatcctgcggatggggagggatgtggtgtccgaccaggacctgtgttgtccgaaacctgccggcttccacggggtccacgtagcccagcacccgcctgtggatctccagcacgtcgctgatggtgacggagccgatgcgcgaaaccagagtcgtgttgatgtacttcatggctgcatgcatgcctatgacctcgttctgctcctccaggctcttcccgggcacggcgtagcgggtctccaggatgtgcctgatttccgagagggtgagggtgttgccctcgatggccactgtgtggtagatgtgatggtagtaggtctcctccatgaccctgcgcagagctgagttccccttggggatggacatgaccttcttcactttgctgtcgatgatgctgaaatacctctggtcgatctcttccacaagaggcagtgtccgatcgcggttgaccagtgctttctcatggtagggtgagatggtcaatgctctggtgtacaagtagtccgcctggatgatgtccttgtcttcttccgagaagatgccaaactcggtgagcgcgtccacgaagtccgggtccatcttgagggcgtgcatgaagagcttttgggctttttcccgcttgccctggcgcttcatctccagggcctggttcagggcagctctggcttccaacttacccgctggaagagagccaaagaagcgctgtgagggagggaggctagggggcagaggacattcggggggctgtcccctgtgctggtctccgcaggaaaccatgatgaccagcctgtgtccctggccttgaggagcttgttgcagccgcatcgtgtgtactcaacatgcccggtaccactctgttgccccagccgtgtggtggtatgcagtcactatccgtgtgtccccagagccactctcttgtattctgggaggcacctccttggcttcctagcctcctgctttctggacatagaaagttctaggcatttacttcgcctgggccctctctgctgggcctttcctgtgggccacagctcccagtgtaggccgtctcctacatctccagctcatcttgtgctggtgacacaggttcctgccccgggaggcccaaaggcgttaacaactccccactcttcctagaccctgggggcgtcaaccatcccgggactgttctttaactcttttaacccagtggtttgattgtgcgccccaggggacatttggtgacgtctggagacctggttagttgtcataactgaggaggtggagggagtgctacaggcatctcatggggagaggccagggatgccaccaccatctaacaatgcactttcagtccccaccacagagaactggtggaggtggggagcctgctctagccctagccctcctgtcctggcccctcttggccacctgaggatcagccccacacattcaacttcctttagttcctcgaatgcccccaggctctcttacgacagttatgtcagttatgacaactaacctctggtctctgcctggagtccttttccttggatgcccttcaccctggatgactcctacttaacaactgggtcccagctcaggtgtcacttcctccagggagccttcctggtatgctcctacagccctttatgcttccccatcaccacacttgtgacactgtctcagtcacatcaccttgtctatactaggagctcagggctgacttgttcacaataccccgatgccccacatacaggacatgacacattctatgtctgtctatccagttaacaagcattgaggaagacggccagtctgtcttacctggagaggccttggtcttggccaccagcagcgtcgcgcccctggaggtgatgctgagctccgtggacgggctggtgcacttggtggcggcatgctgcgccctgtccggtttgctcctgagcaggtagaggcctttgagcacagccaagcactgctcctccacagcccccagcggcagcagcagggccagcagggaccccagcaccatgctcagcagcgtcacccagaggaagcggctccagaccgagacccatttcggttcagtcaccgccatcactgaagccattggtatgagcatcatctggactcaggagagggccctttgcgcatgtccacaggcggctgagagagagcaggatctgcaaggagccaagagtcgcaggagaaacagacacgttcaggacatagtgtgacttcagctgggaagatgggtttggagacttctgctcttttagctcactagagagatggggtgggggcaagtcaaggactggatctcactagaggaggggccagcctagaaggactggtgccacctcctgggcagtatgaatgtgaaaacactgctgtggtccaacaattaatgagcacttgccataatccaggccgtgtgctaagcaccaaatgcctcacatgggtcacctcctgcaatcttcaacgacttgagctgatgttttcacccttctccaggtgagggaactgaggttcagagaggtgaagtcccttgccgaaagtctcgccgggagcaagtgacagccttaggacttgaactcaggaaccccacggctctaaagtgtccccccttcccatatatccctgtggcttctgaccacaaacactggatttgtggacatatgtcaaacatttgggacataaatgactgacagacacccaggcagatcagccacagcagttctgacgcccaatctttgataagcacaattgttgggtggcctcatttattgccctcaccctgatattcagccacagctcccacagtgcccttcccctctctggccttccatttctggcctgtccagaagggaccccatcaagaagatgagcagttcgagcatctcgaaaggaactcaggctgtgggccacagtgcttggcctcagtgacaacatggcttgtatgtgcttggggctggcagtgggagtggaggtggggccaggcatgcaaacactatgctaacaataagcacttattaagcaactatggtgtcctaggtgctgagcagtgtactggccacgcattgcctcgtttcaccctcatgccaccctatgaaggaagagctaccgctagctccattttacagacaagggaaaccaagacacagagagcataagttaaattccagaaggcccacaggaggtaaacagaggcatccggaaggaaaccccagggcctctgaacccggtccccaggtctcgatttctaccttattactaagcagggcctgtgcacctgctctgggctggtcctgacccgggaatgactgatggatcacggggttctgagtctcatggggatcctggcccattgccacagaacatgtgaaatggcttggggtgcgctttaataggggtgcgcctggagtgctgcgcgggtccaggggtctgggcgggcttcccgaggggacaggctcctgggcggggcggtacaggaaagggggcagttcgccggtgccaggggtgtgtgcagggaaggagtgcgttctgggaggcgcgaatctctcccccacacttccctagaaagggagaactgaggcccggagaggggaggggaccggtctgagtcccctccaagactgcagagcctcccttcccgaaccccgcccagggctcgcggccccgtcgcacccttcccggcttcatcctctcgagcccctagggcttttccccttctcaccgcgcgcagctgtcagaaccccaaccgccttccccgcgctcccagctccgggccgccggctcccgggtcctcc

SEQ ID NO: 15010 - DNA, 254 bp, Homo sapiens
caatgtttgttccattacatatgatttagaaagctcatgaggagaggaggataatctgtcgtagttcccgtatttctgctcttcctgttctttcttcctttttgatgctttaggattccttcttctaacttttctgttcgaagaacttcctttagctattcttcaagggtaggtctgctagtgacatttttttcatttttctttgtctcagatatatggtaacttaaaataattttagtttgaaaagtttcaaa

SEQ ID NO: 15011 - DNA, 4319 bp, Homo sapiens
caagtccctgcaaagaagcaccactctagactggcaagggcctccacagtgtggaggtcccattttattatttttttttttcgagacactctgtcacccaggctggagtgcaatggtgcaatctcggctcactgcgacctctgcctcccaggttcaagcagttctcctgcctcagcctcctgagtagctggcattataggtgcccaccaccatgcctggctgatttttgtatttttagtagagacggggtttcgccatgttggtcaggctggtctcaaactcctgacctcaggtgattcgcctgcctcggcctttcaaagtgctgggattacagacatgagccactgtgcccggcccccattttattttagttttattttgagacagagtctcgctctgtcacctaggctggagtgcagtggcgcaatctcacctcactgcaagctctgcctcccgggctcaccccattctcctgcctcagcctcctgagtagctgggactacaggcgcccgccatcacgcctggctaattttttttttttttgtattttaagtagagacggggtttcacctgttagccaggatggtctcaatctcctgacctcgtgatctgcccgcctcggcctcccaaagtgctgggattacaggcgtgagccaccgcgcccagccccattttattttttactttaaatgcctgccaaggagcagcctcaagcccagagaagactgaggctacggggaacttcccttgctgcaggctgttgtaacactttaagggccccaggtctccactgccaagcaggacttggcacatgagcacccaccccacagcaccatcaggcagcacccatgggctccaccagcccagctctgtccctcccctaggtaaagatcacactgaagtcttcaagtccccagcaaccaagttgggggtggtttccttcctcttcaggcagccaggcccatggctggaaggccgggctggaggccagggaatcggttactgatgtggccaccctattcccacatggggagcaccaggagccctggagccccttccacccaatcccatctcgcaggagagcagggtctgggctcctgcctcaccgctggttcagcagcaccctccccgccgggtcccaccttgccttttgaagaagagcccgcataatgagtggacggcagacagctatatttagtggtgcctcgacactcacgaaccgccagcgtggcgcctggatcttgcccagctgccagctccccccaccaggactgtggttcctcagtttctcctgccagccccggctcatctcagggcaaagctatagacatggtagatctcatcggggaggttctcctgcctctcctcggccaggaggctgaggcctgcactgcagatgatcctgcggaccacgtcaaggtcccggcacacgctgctgtccacgtcgtccagaatcacgccctcctgggccatgttgtctttgatgacgatgatgccgttggggcggaggctgcccttgcagcgccgcaggaactcggccaggtgctgatcggtgaggtggcctggggagggcagaggcaaggttaccagggcaccatgcaagcggatgtcggcactggatgggatgtacttctcagccccgctgagcccctcatttgtgcccagcattttgtgtgcacacatggcctcattggctctcagtcccgagagatttactaaaccccaattcatagaataggaaactgtggctcagaggtcatctacctaaagacacattaagccagaatttgacttgacgggatggcttacaagtcctgcctgatacctacacaccatgatgccccacccctgccaggcttggatcggaggagtgaacctgggctaagagtttggcattgcaggagctcccagagagactgccttccctacactagaagtccccacaaaggcttctgagaccacaaaatacaaggccagacctagagtgtccacagcaggcctgtgctgcccgcctcaggaggtggccgactgctgctagcggcctgccgccacgtcagcagcccagggcacagcgctcgaggtgtgctgttaggctaagagggtgcagggctagacacgaagcttaaactattcatcttattaaaaataaaacccttataaaactcctcactttgaatgcagtaagttattggccattaaaattttttcaacaaaaaactgcacccaaatggatggtagcaggtattcaactgaaacaaaacctagaaggaagaaatctaccttttaggccgagcctgtccctcagtcctgggaagtacggggtgggggtgggcctgggcggggtggggaatcctcactggcccacttgctgcaggagtgcaaagccctggtcctgacaccttatggggaacgcgagtggcaggagacatacaggtgagcagggaagggcggtggaaccctcacctatcacccactggatccagatcacgtcgtaagagtccggctccggggtgaagtcctggagcccacaacagaagtagttcctcaccctcttgccctcctcccccaggtaggtcttggcttgaaccaggaagtcctccgttatgtcgaccatatccacctctctgaacagcggcaggagcagccgcttggtgatcctcccaatgccagctccacagtccagggcacaggacgttcctgtcttgttcgggccttcctgaaaagcagaggcatataacctatcagagggaccctgtcaccgcacgtgcggcccttcctcacgagccctaggacttagactcaagtcaggattccaggactccgcacaagctgagcactggtggggaggtctgtgctggctgccagcttgtacggagtcgaggggatgagcatgggaggacacactgctgggccacacattcctttatctttgaaagttcaggttgcattctgcattctgttcaggttggaatgcagtggtgggatcatggctcactgtagcctcgaactcctgggctcaagccatcctccatcttcccacctcagcctcccaagtagctgggactacaggcatgcgccaccatgcccaactcatttttttttttttgtattttttgtagagacggggcctcggtctgttgcccaggctggtctcaaactcctgggctcaagcaatcctctcaccttggcatcccaaggggctgggatgacaggagtgagccactgcccctgccctgggccacacatttctaaatgaaagctaatttccacttaaaggtgataacttgaacaggtgcactaatctctcctgagtctccaggtaaacaacggcagagaggaatggggagaatggaagcggggcaacaggtgaacaagggtgcagagagggaacatggagggaggggaggcgctggatggagcaggtggccaacagcagcctccagtgccagccatgagacaagaaggtggggggctccaggactgggggtcccagcctggtacagaaaaggctgggggtggagcagagggtggaaaccatggcacataactaggagtcttcgtccagaatagccaacaccctcagtccaaacacccgtggacatggcaggagagcaagggtttcgtccctggcaaaacccaacagttgaagagaggtttgcccaattcaggcacctcaattctgcctaacagccagctcctgtctggtaaccctgaggctaagtccacaatctagaagttaccccactgtgcccacccagcccagctcctcaaggctttggggtaggtaccaagagatagccaacaatcctgcagtgttacatgtgtaaaaggtggcaccccacatggactcggcagtgccaccagagccacagcctctcctggagagcacgccagacctgcctaccctcaaaaacctctgcagaaacttccgggagctgttgatgtcgatgctggagatgtggccataccccccaagcatgccgtccaccgtgggtgggatttgtttccagtaggtcttggccttggaatagaattgcttctcgtcttctatcacctcgctcgtcatgctgtcaccaaccacggctctactcaagcaccacgatcagcaaccgcgactctcctgggtaaggaagggggcgtgagtcagcgggccagggacctggcagaaaggcccccagggcagagggccagtctcacaccaggcttcacaagtcacacatcctgctgagtgcagagagaagtccagggtccccaaatctgcttctaccccttggataacagcatcttctgtcttttgcactcagagcacccgccccaag

SEQ ID NO: 15012 - DNA, 5227 bp, Homo sapiens
ggggctggactggcggacaggtggggtccgcggccgccggagcgttccggtcggcgtctgggcatctcggcctcggcagaaagcgcgacggccctgctgcgcggggcgcgcggcgatagccgttcctgcacggcttccggagattcatcttcgagtaccagccgctggtggatgcgattctgggctccctggggatccaggaccccgagcggcaggagtctctggaccggtaactcaccccctcccgtgagctggccgaggccgctccgaccccgcagcgtcccagtttatcaccacaagccgggcggggtggatgcgtcccccttgacagaggaagggacgggcggaatccggggttgcgtggctcggagtgcgcgctgccccgcgcggatcccactcctgccccttgcatggcggagacgaagggcggggagggccgagggggaggcgcccgctggttgtcgcagggcctgcgcctcagccccaccctgtcgcctgcctgtcctgtgccaccccccggcgtggcagaggagcagggtggaatccgtgagcctcagatgttaccccagagcagtgtgaaggtgggcttttgtagcagagtttgcgtttttatagacaagagctggtctgtcgtggacctgcaggaaaggggtcgggagcgaatctgcattcactgcccatggtactaggcacctggggtccatcagtggctcagcaaaacccccgccttcttggcgcatgtgctccagaggagagactgacaagtaattgtacggcggcacgcgaggtggaagggaggggagagcagaaggaaggggctcggctcaggtgttgagggggttgtcagttggtatttccaacacgtggtaatgatgagtctcgccatccagggactctggtggaaacgtaggctttcttcatcaatatcagctgaaggtctcaatgtgaggggagggaggaggctgtgttgctgtcctggctgcaggtgttgccggggctggggtcctgcgggtttgaggatggaagggctttctgaggaagaagcatcaaagtcgggcttgggctcttggcctccaggctggtggtcccttcagtcccagcagcccaggtgtgtgaggctttgtacctaagtctgcgaccggactctgggcaacgcgggaggagagcgcagacagacccagcccattctccgcaaatcccagtctgctcccgtattaagagatgcagcgtggccctctctctacttcagagcttcccccaagcccctgtgacccacagagccagggccctgcttgctgatgatgatagcaggactaaagcccaccaacccacaggctgcgcggtcacccggtcccacagctgtgcctaccctcagcctctctcctgtcccaggcccagttatgtcgccagcgaggagagccgaatccttgttctcactgagctgctggagaggaaagcccactctcccttttaccaggaaggcgtgagcaacgccctgctcaagatggctgagctggggctgacgcgggcggccgacgttctcttgcggcatggggccaatctcaactttgaaggtcagcgagagccccgggggtgggcaggtggcttaaacgcggcccgacgctgggtgggcgcccatgtccccagccttggcttctaccatcctctgaggagtgacttccccccctttatttcctgggtggctgcaactaaggaaactcccattgggtggcctcccaccccctgcgggttttcacatggctcttcccacctctgttccaagagcgagtgttgctgcttctaccatgtgattgattagcaaactttccccagctcccagattaatccccacttccattaatgcaaaaatgcggctgctggcactgtgcccagagctaagggaaggtaattttctgctacttactctgagccaatttgtttttttttttctcatgccgtagggagaggggaaaacaggctgcattaggcataaatcaccacaggacaccctggctcctggctcctgagtgccagggatggagatggagccgagctcctttctctgtgtttttcagcccagggagggcagggttagtcggcagacaggcagggctgccttgtgacctaataggggcctgagacagccaggcacgtctcctttccccatccgaagacgggcttggagtctgctgggctcctggagggtcaaggagctgagacgggagggccggttctgaagccagtgacttggagaccagcttggagaacctggctgttaccaccaggcctacaaagcagagccgccagagctgctgtgtagcgcggcctcccagccattctgagagggtgcgccccgttttatggtcccttcttacagaagaggaaactaaagcccccaacagcttcagtagcgtgcccactagaacaccccgagggccctctagtatctggtgaggacagctctgtcctaacccttgatggtgacaggaggctgggcctgtgcttctggacactttaggtgggagtttggggctgggctctgggtccgggggccccataagaatgcggacagataggacccacatgagctgtgtctgcaccttcagacccagtcacctactacacggccttgcacatcgccgtcctgcggaaccagccggacatggtggagctgctggtgcatcacggggccgacgttaatcggagggaccgggtaagtgccaggtccagcttgctttgaagcagggttgggcaggggcctgagcagcttcccaagccaacctggctgtgcttccttggctcagatccacgagagtagccccttggacctggccagcgaggagcctgagcgcctgccctgcctgcagcgcctcctggaccttggagctgatgtcaatgccgctgacaagcatggtgggtgcctcctgcaggaaagcaggacagctgggcccccaggcaccttgtgggggacacccagggtgccccaggacaacagctaggtgggcagactggatgctggccctggctggtggcacagcatggctgggcacacagggattctgctgacttgctgagctcagaggcttcagagaggcagtgcagtcattgtccctgtgctggccctcaagggccttctataggaagaaatagggcatgtgtgcacttagtttccaagaaacaatggcttcccattgggagaggcccagccaacatctcaggtagcatcttggggtccagaaaaatcctacctttcctggcctttccgctcccacttctctgggtggaaagggaatggccagaagcctgtcaccctcagccctcacctgagctgagagttgtctctgaaagttcatcttctgatcctctgagtgtctggatttctgccacctcctctgggttgccctgacctgggcttcctggcctcctgctcctccttgctctccctccctccctaggaaaaactgctctgctccatgctctggccagcagcgacggggtgcagatccacaatactgagaacattcgtctcttactggaaggaggtgaggctggcgcgctcctaggcctcgtcctctcacccgccccttcgatgtgtgctgttgctttgccagggttgaaggccttctcccagcatctcttgttctatggctcttctaggggcagacgtcaaggccaccaccaaagatggggacacagtgttcacctgcatcatcttcctgcttggtgagaccgtgggaggggacaaagaggaggcccagatgatcaaccgcttctgcttccaagtcacacggctgctgctggcacacggggccgaccccagcgagtgcccagcccacgagtccctcacccacatctgcctgaagagctttaaactgcacttccctctcctgcgcttcctcctggagtccggagccgcctacaactgctccctgcacggtgcgtcctgctggtctggctttcacatcatctttgagaggctctgttcccacccaggctgcacggaagacgagagccatgcggacctcctgcgcaaagctgagactgtcctggatctcatggtgaccaactctcagaaactccagctgcccgaaaacttcgatatccaccctgtgggcagcctggcggaaaagatccaggccctccacttctccttgaggcagctggagagctatcccccgcccctcaagcacctgtgccgtgtggccatccggctctaccttcagccgtggcctgtggatgtgaaggtcaaagccctgcctctgcccgacaggctgaagtggtacctccttagcgagcacagtggctccgtggaagatgacatctgataggtctcaggctacaggaacgggggacacgggcagctcaggtcagcctgttggtagatgctgggacagcattagaagagggtctttttgatctgggagatgagacgggatccttcatgagaaaagccagccaggtagagcctgaagctgtgatcactccagtggtgaagggtgcagctctggttcttccagagagactgcccccttccctccagcggcactccaagtcccccccatgttggaaagaggaacagggcttggattgatgtttataccctctgaattggaggggcagtgccagggcatttgcagaagctgggaaggaccaagcctcagcaccccagggctgcggggctcttgttggccgcacgtggcagtgcagctggagaggaagcctggggcacgtcctgtgcggtgccaccaaggccccacccctgccccttttccttccaggttctgttactcacagaagtgtttctggtgggctctgcgggagaagacactaagggccccacaggcttgtttcatggtgttgcaagccaagctggcccctgcctgttcctgtagctctggggccaggtcagccgtggccccacctaccagaactgtgctctgctggcagctgtgcttttgccaaacccagggcctcagcgaccatgacttctgctaaaaagcaatcatgagtgcgtggctggggacagacctctctgaagtgtctcctgttgtgaggggctcactttggagccactgaagagccgactgtgccacccacttgcgagcctcagtcccttccaagctgcactggtcattgggaattgtgtaaacacctctggggataagctgaggtgactaaatgatatatttatattataagattaaactgactttcttggccttaacaa

SEQ ID NO: 15013 - DNA, 1067 bp, Homo sapiens
agaaaaactcaactcgtctcacaactcagaggtacaatgaaaaggagttttttcctctgtgattggaactttctcttgagccctttcccttaggggatactaggagacaattacatctctaattcaacctaagtttattcccttttagtggggttcaatttctgttagccaaaagtgctcagtccctcaaacagcttatcttttgttgtttctctaagattgtgtagaatttggaaagggtatagcttatttgaccttatggctttgtgcggaagccggggtccccagtagatctcctggcttctggataatgtttctttgctgctgggttgctaggtgcctcattggcctccactgccaacttctgggtggttattacttagggttgtgactattgcttgggcaatgcacctgcaggtgctttctgggcaattccatttcatccggctcttgatggcaacatcagcaccttggggacactctgcgatatgtgttttgcttctgttttttgtcccggattttctgcagggtcccctgtctcaataaggaaaactccttctatcagtttatccagggtaggcaggcaggtacttctaggtccgacgcagtgtgcctcagtggaccaggatcatggacacaggacatgggtaagttcctgaactcctctctgcctaaggttcttcatctatcaaatgaaagtagtaatagtgagtattcactgaacacttcctatttggctgcactttttaatgtgtttcatattatgatgtgccaggcagagctctgtaataagtcagtgcttctcaaactctctgtggtaaatgattaccttttttcttgaatttccaatttgccacagatcaatatttctgcaaagtactttaaaagttacttcctatgagcttttacagtgacaaatgaaaattttaaaaaaaaccttaaaattgaaatcactgtacaaattagttattggttataaattactacaaacacttcaataaatatttaacaaataaaaaaataaaaaacttaattcctagaaaatgacataaaaaaaagaaaaacaa

SEQ ID NO: 15014 - DNA, 1067 bp, Homo sapiens; identical to SEQ ID NO: 15013

SEQ ID NO: 15015 - DNA, 1065 bp, Homo sapiens
agaaaaactcaactcgtctcacaactcagaggtacaatgaaaaggagttttttcctctgtgattggaactttctcttgagccctttcccttaggggatactaggagacaattacatctctaattcaacctaagtttattcccttttagtggggttcaatttctgttagccaaaagtgctcagtccctcaaacagcttatcttttgttgtttctctaagattgtgtagaatttggaaagggtatagcttatttgaccttatggctttgtgcggaagccggggtccccagtagatctcctggcttctggataatgtttctttgctgctgggttgctaggtgcctcattggcctccactgccaacttctgggtggttattacttagggttgtgactattgcttgggcaatgcacctgcaggtgctttctgggcaattccatttcatccggctcttgatggcaacatcagcaccttggggacactctgcgatatgtgttttgcttctgttttttgtcccggattttctgcagggtcccctgtctcaataaggaaaactccttctatcagtttatccagggtaggcaggcaggtacttctaggtccgacgcagtgtgcctcagtggaccaggatcatggacacaggacatgggtaagttcctgaactcctctctgcctaaggttcttcatctatcaaatgaaagtagtaatagtgagtattcactgaacacttcctatttggctgcactttttaatgtgtttcatattatgatgtgccaggcagagctctgtaataagtcagtgcttctcaaactctgtggtaaatgattaccttttttcttgaatttccaatttgccacagatcaatatttctgcaaagtactttaaaagttacttcctatgagcttttacagtgacaaatgaaaattttaaaaaaaaccttaaaattgaaatcactgtacaaattagttattggttataaattactacaaacacttcaataaatatttaacaaataaaaaaataaaaaacttaattcctagaaaatgacataaaaaaaagaaaaacaa

SEQ ID NO: 15016 - DNA, 453 bp, Homo sapiens
ttgggtttttcgaaatgttttcatttattttataggtataaacattaaagctgttattacatttctctttcaaatatacaggtatatataacatgtaatactaaaatttgtttaacttataaaaaaggttaaaaaccttacaataaaacaaggaaacaaaaagacataacacaagatctgtcctccacagaagaaaatgctcgcatttcctctcctttctccattaatgctgcattagtgcggtgtaggcagagacgtgcttccgccaggaaaaacctcattagtctctggaagaatcactgcccgcctgtctcattgtctccccagccattgcaagcacagtccttaaggtgttatgctccctggggaatctgaatccacttacatgctcccctgtgggctgcggcacttaacttcccttgtcctcaagtttggttaatgggctgggaagcg

SEQ ID NO: 15017 - DNA, 411 bp, Homo sapiens
caacaacaacaaaacaggaggtgttattgaagcttttcctgccaaaggcagagaggtaaaagaaaaccaagatgagcgtgaagggctgtgtgtgtctgcgggggtgtgtgtgtgtgtgctctccgatttccttctagtaaaactctcctaatctaacttggctccatagtgaggcagacattactgagagcagtaagtaatgtgactatctcaattcacggtagactctcaacttacttatatgtagactttgaagaggatgaggtttgggagttgggttacaggtgtccatttaaaatactgaacctacaatttctccacctctgttccctgcagaggcatttctgcaggacatagtatcaggcctggtcctgaagttctattagaactctgctctgtcatccaggctgg

SEQ ID NO: 15018 - DNA, 118 bp, Homo sapiens
tttttttgttttgagacagagtctcactctgtcgcccaggctggagtacagtggcacaatctcagctcactgcaacctccgcctcctaggttcaagcaattctcctgcctcagcctcc

SEQ ID NO: 15019 - DNA, 453 bp, Homo sapiens; identical to SEQ ID NO: 15016

SEQ ID NO: 15020 - DNA, 453 bp, Homo sapiens; identical to SEQ ID NO: 15016

SEQ ID NO: 15021 - DNA, 411 bp, Homo sapiens; identical to SEQ ID NO: 15017

SEQ ID NO: 15022 - DNA, 3064 bp, Homo sapiens
ctcactgcaacctctgcctcccaggtttaagcgattctcctgcctcagtctcccgagtcactgggactacagatgtgcgccaccacacccggctaatttttgtgttttcagtagagacggggtttcgccatgttgtccaggttggtctcaaactcctgacctcaggtaattcactcgcctcagcctcccaaagtgctggaattaacaggcgtgagccactgcgcctggccagaaaaacttttttattctctggatagtttagtttcactactaagatgtggccttctgtcaggaattgctagtgaatatatcccaaggaaccgatgagcacaatttccaccctccaagaacttatgactgtgacaaatccataaactcttctatttggtagtggattccaggccacatgtgagttctgggaactgttcagtggacagttcccaggttactctctttgcctgacttcatggagttttatgctacacatgcaagtgttagtgttcagtgaagactcataaggaccccctgcatatttctgaaattctttttccgctttgctcccttctctctagaatttgcttcacagtttctaactatttcagtctccctgaacattgatccctctctcttcagtgcaggggaggaccactgtgctgtgcttgagctctcccctcctgcttcacaggctcccgtctggcatgtaccttctggcagaaagcaggggtgattggggggctcactttgttttccttctctcacagctcacagtcttgtatgatctcttgtccagtatccgaaaacagttgtttcatatattttacccaatttgctggttattatttataaggctgaagggtaaacttgtttctgtctctttaccatggctggaagagaagggtttccgtagactctagaagttaatcccatcatagtgatgttagtatcttcctggctctgtcttctgtgtgttgtgttggagattctgcctttcagtctgtctattcagtgagggcaagtaatgcaggccaaacaatcccagaacattcattcataagtgactagtatgagactgggtgaagtgaaagttggttttccaaatgcatcgctcataagtctctggctttaggcctgttggaggtccattcctgcagaaggcagttctgcacagacttattgattaattgattcattataatatagttagcaaaactttacagtgtttctgttgtgggccatacactgcccttgctggtgaagcagcagcaaacactgagtcttcagtgattccttggttaaggaatgctctgtgggtcagactcttggggatccgagacagagaaggcacagtttctaccctccaagaacttacaactgtgacaaatccacgaactcttctctcttctttctgcagctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaaggtgaggagtccttttgggcttttggcttgcactgtgaaatgagtgttggtttggatatttgtggtaataaagttttttcctagagacacattttagtaaaataaaaatcccctctcaaccagtacaatggaagggcactttggattggattttagactgctccttactaatgccttcttattcttcttacctattctcctgccctggaagcgttctttgtgggaatttggtgagtttggagtatgcagtggcatgtagtttctcgctgcagagaggccaggaggtggagtgatttcgagtgagtagagagtgttccctgttggagatcaacattttctttgtgatctctgacggctcaggcctctttaacttacatgtgctcgagtttcttgggtctcttccctggactcacagatcagctatatggctgtgggattttctctccctttctttctctctttctttctccctttcactggcgatatgcttctcttattgtctccttccatttcttcctttcttctgccttctcttctcacactgcccagttctgctactgccaccttccctgtcttgttctcatatctgcttcgcctcagaaccagaagctggcaggacacagactgatgccctagagcatccacagaagttcctttaagggcagggaaaatgcctgttttgtttctgtttgtttatctttgtttatcttctagcacctagggcaattccgggtacaaaatatgtacttagtaaggatttactaatggactgacttgctcttatgataagacatgtgaccacagataactttggggtcacattcttttagctctcaattggaggagagagaacatttctcaccaaatgttggctgtaaatatcctaaggaaggatttgactggatcagccttggagttaggagggcagggcctgtgatgggcagtttcacctgaattttatggttagagctgaggaggagccatcttccaagagaaaagggagaagtggctgggactgacctgctttgacttcttaaattatatccattgccattccatgagacctcgcttcctgccaggatcgggggcacacaggagccatgtggtctctgccagccggtcgcctccatcagattccttttgggggcttctcctctagaggctccacatgaagtcccagtgctacagtcctagttattttgccttcttctgcctggttttctttcagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 15023 - DNA, 3064 bp, Homo sapiens; identical to SEQ ID NO: 15022

SEQ ID NO: 15024 - DNA, 1654 bp, Homo sapiens
gctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaaggtgaggagtccttttgggcttttggcttgcactgtgaaatgagtgttggtttggatatttgtggtaataaagttttttcctagagacacattttagtaaaataaaaatcccctctcaaccagtacaatggaagggcactttggattggattttagactgctccttactaatgccttcttattcttcttacctattctcctgccctggaagcgttctttgtgggaatttggtgagtttggagtatgcagtggcatgtagtttctcgctgcagagaggccaggaggtggagtgatttcgagtgagtagagagtgttccctgttggagatcaacattttctttgtgatctctgacggctcaggcctctttaacttacatgtgctcgagtttcttgggtctcttccctggactcacagatcagctatatggctgtgggattttctctccctttctttctctctttctttctccctttcactggcgatatgcttctcttattgtctccttccatttcttcctttcttctgccttctcttctcacactgcccagttctgctactgccaccttccctgtcttgttctcatatctgcttcgcctcagaaccagaagctggcaggacacagactgatgccctagagcatccacagaagttcctttaagggcagggaaaatgcctgttttgtttctgtttgtttatctttgtttatcttctagcacctagggcaattccgggtacaaaatatgtacttagtaaggatttactaatggactgacttgctcttatgataagacatgtgaccacagataactttggggtcacattcttttagctctcaattggaggagagagaacatttctcaccaaatgttggctgtaaatatcctaaggaaggatttgactggatcagccttggagttaggagggcagggcctgtgatgggcagtttcacctgaattttatggttagagctgaggaggagccatcttccaagagaaaagggagaagtggctgggactgacctgctttgacttcttaaattatatccattgccattccatgagacctcgcttcctgccaggatcgggggcacacaggagccatgtggtctctgccagccggtcgcctccatcagattccttttgggggcttctcctctagaggctccacatgaagtcccagtgctacagtcctagttattttgccttcttctgcctggttttctttcagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 15025 - DNA, 1938 bp, Homo sapiens
cccaactgagccctacctcccttaccaaagaagttcatggccaagccatttttatttagcaaataagggcttgttttccttgattgtccaaagcacaaggggagaaaaaccacccattggcttcatgtttacctgcactgcggggctgtcttgtctgtttcagttctgtttcacatgtggagttttcactgatttcaagaaggaatgtatgcatggagttgagcaggatacagtatcctgaatgagggctgaatgttctgcactagaagtgagcgtatcaagtctttgtaactaagaatgtgatgttagattgtagctgaggggaagaaacacaaatggcttgggttgtatctaaatcctgggtctgccaggtgaaaacttagatgttgctttcaaatgacactaatgatttctttcagtgctgtttagcatgagtggtcattgcaaagagctgtgaccactgtactacccagtatggtggctactggtcccatggggctcttgagcacttgaaatatgggtaatctaaatggagatgtggaaaatacaaactggattttaaagacttagtaaacttagtattttgaaagagcaaaatagcccattgacaattttatgttgattatacatacattaattttacttgttatcttttaccatttttaagtgcagctactaaaaatttaaaattctgtatgttgcttacattatattgctcttggacagcactatactaaaggcataaatgtaagattgtgtttcagagggcacccgagcactgcttggtttatatgtattttctaggccttccctttggttccctggttacctttaaaaatacatgtcatgatatagacatggcatatctgagacaaaccttggactgagacaaacctgagtttcaatctcaattgtttgtttgtggcttgcctctcagcatcttaaattctctgaatcttaagttcctccactgtgtaaaagaaataatatccctctgacctcactgtggttaggcaagagacaatgcagtgattttttcagtaatattatgagacattttattactataattaaatgattgtattttccccagattgacaaattcaaattttctattttgaaatcttattgcaaatgttaaaaaaacaaacaacccaccctttggctcctgttatgttgtcttccagctgctagtaatggaattgggacagctaatgttccctgagagccatggggaaccaggcagtgtgcttttcaggaactgtcttactttatcctcacaacaatcccaaaaggaaaaacctagttttatctctatttaatagctgcagtgactgaggcaccgcaaggttaggtgacttgcccaaggtcacacagcgaagcattgagcccgggcagtccagctctagagccgtgttctttgcctccgcccaatattgtccaccagtgaggagaagacggaaccaaagaaccaacagtgaatgaatactaacaggaatcctggctttcatggacatctattcttgtgatttgacagtgtatatgtgagatacttcctcttagaatgctttttctaattcatacagtaggcttaaatatgtcatggttttagagttttccttaaggaatacgttgattcccaggcacattacagtctgaatcagtcttaagaaattccaggatagaggtggaagaagttttagtaaattgttgtgcagcatggtgaccgcagttaataataatgtattatatatttcaaaattgctgaaagaggagatttcaaatgttctcaccacacccacacacacaaaaaaatgataagtaggtgaggtgatggatatattaactagcttaatttaatttttctcaaaatatcacattatatttcataaatacattcaattattattagtcaattgcaaaaaaaaagaagaagaa

SEQ ID NO: 15026 - DNA, 1938 bp, Homo sapiens; identical to SEQ ID NO: 15025

SEQ ID NO: 15027 - DNA, 1930 bp, Homo sapiens
ggattagaaggcattgatgtattaatagcttttttttttttttttctcaagcatggtactaattcttaggtggggtcaagatgattgcggggggcagtgggggcagcctgtggtcaacgttcaaagccttccagtcatttagaaagttgaaatgtgcttggtgctgggctagaatcattaggaggaaatagctgcaaacctggaaacgtccctggagaatacttaattcaggaataaaggtttggattgatgagggctaaaataaaacttggcagcgacagcattctagtaacttttagccacttctccccatctcactggggtattcctgctggtatattcactagcctgagctctgctcctgagagggctgcaggagctgggtgggttgggagacacaggtgtgtgggaggcgccttcaccaagtgccgcacaattgccgggtacccctctgtgcctttaactggtcggtaaacagaaagcaggatgtgcttatctgaatagtgacaacagttgcaagcactcagtcacaaagttcagcattctggctttagatggaccagcgtggggctctggaagctggtgacttgggagtgcctgccgtacacatgggtggggaagggatggaaagtttgtcaaggacttgccgagttattaagcaaagactctgtaagtgcgtcagaatgggaaggcagctcagaacctttccactccaccctttttgttgttggaaataggtaaactgaggccagtgaacaggaatgtgtatttcaataataccaaagctaacttctatcactgtgagttgtgtgccaggccctgggttcactgccttctgagtgttgtctcttttaatctctgccacagctctgtggggtaagcactggtgttatacccatttttcagataaggaaacagagcctcagagagtcaggttacttcctcaaggtcatagaactagtaagtcacagacctagggcacaggagcaggtctgtgtgggggtcagagccacagctgtcccccacacgctgggggcctcctccacaaagcggtttcaggtggggctcagcccacctctgggggaacccattcatatactatgcaaggtttcacaggtgtgtgaattcattttccattgctgcgtaataaattaccacaaacttaatagcttcaaacaacacatatctgtcattccacagtttctgtggaggccaggcctggttttcctgagttctctgctcagagtctcacaaatctgtactcagggggtcagcctgattatggtcccacctgaggcttgggatccccttccaaactcactaactgttggtggaattcaattcatgcagggagagcactgaggctgcaagctcatggagaccacccactgtttcctatgtgtggccctctccacaacacagccctttgcttcttcaaaacccaaccaaagaatctctgtcttcaggaacagcctccgaccctctttgaaggggctcacctaattaggccaggcccacagaggaaaagctctcttttgattaactcagagtcaactgattagggactttatacctgcaaaatctcttttgccacacagcataacttaatcaaaggaatgtattccatcccattcatggatcctgcccatactcaagggaaggccataatacaagcatatggtcattaggggccatcttagtcactactgttcgtggattgttctccagcttcctggaggagaggagagcaggagacagagctaagagtgtttgtaaaatagggcagtgggaaaaggtaggtcttgtgagtagcaggctacttaagatgcctagtgggtctaaatgtcaaatgctattggcagattttccgtgcaaggtatgaccaaaaaataattatttcattaactttgtgcaaaaaaaaaaaaaaaaa

SEQ ID NO: 15028 - DNA, 5741 bp, Homo sapiens
gaggatttttgcagcgtttgcagaaaaagtggccagttactgatgtgcgacacatgttcccgtgtatatcatttggactgcttagacccccctctgaaaacaattcccaagggcatgtggatctgtcccagatgtcaggaccaggtactgtgggtgggtccaacaggggaggggccgaggaggacaaagacacggccatcaggaggaattcctttcccggggaaatggcagtctcttctctctcccagtccgtctccgggctgcatcttccctgtttatgacacagcacgcaggcgcatggccttcattccctcagaagccctctgccatattactgagctggatagatgcttccttgtatttgaaatgacttgtcttctctttaaaagtcaagaccctttaaagtccagtgtgcctcattctctaggaatggtccagaccaagtatatggttttaaaactcttctttgggaatgaaattaagggaaattgcccagttgattaattaaaataacaccctgggccaggcgtggtgactcaggcctgtaatctcagcactttgggaggccaaggcgggcaggtcacctaaggtcaggagttcgagaccagcctggccaacatggcgaaaccccatctctactaaaaatataaaaattagccgggcatggtggcaggcgcctgtaatcccagctacttgggaagctgaggcaggagaatcgcttgaacccaggaggtggaggctgcagtgagcggaggtcacaccactgcactccagcctgggtgacaagagcgagactctgtctcaaaaaaataatactaataataaaacaacacccatttcacttttaacctattttgttatatcaggctcagagaactaagtgtaaagtgctgtcgatattttatagacttaaaaggcaaacatattagtaactgtcctagcctccctcgttctctctttggtttctggtcgccttttctcaactatgcatgtatatttatgtctttatgattttattataagctgtctcaagtcttttttagaggtaggcaaagtataaataataaataagcaagcccaatagctcagcaagtactgggattctgctcagttctttggaatcctgctttgaacaaattctggttttcccttgtaatattgtcctcatcctgcagcctgtggtgcagcggaacacttctctcagtgtcctcctcctgatgctgctttgtgaccttctgacgatttttgacatagggtctagattatactttagtatttggaactaatatttaattttcttggtcaggctgtctttgagggacatcgaaatctaaaattgagacaggcagcccatgtcaggtcaaggacgaaactgccagtggctgctgccatcatgctgatgtgcagcttttgtgttggtggttctagctgtcgggagtggttgggtgtcatgtggcgtgtgtgaaaagataggaatgctcagccaagtcccagctccttctaagcctgggctcaagtgtcctggctcttcctgccttgaacttgattctcctaagctgatatttggaactttttagtccagaaactatagaccagggttttgcaacactgctaccataaatccttcctggattttatctgccagtagccacagataccactgctagctgttacatagaggatgtgtgtttaaacctccttctcaaggtaaaattctaaaaatcttttcagatgctgaagaaggaagaagcaattccatggcctggaactttagcaattgttcattcctatattgcctacaaagcaggtaaggagttatccatacccacttttttgtaagcttccccttgtttgaaaaaaatactggcagtatttgttttattctcaaaagggaatttaaatttaaaaatgaaaaccttttgcccttaactattggaggaaacaaagcaaatgaaaactttttattggataaagtggaaaacttctgtagcatttattattattattattcatttattttttgagacaaggtctcactgtatcaacccaggctcgggtgttgtggcatgatcacagcccactgcagcttcctcctcctgggcccagtcgatcctcctacctcagcctcccaaatagctgagactataggtgtgtactaccatgaccagttaactttagtattttttggtggagacaggtttcgccatgtcacccaggctggtctcaaactcctgggctcaagtgattcacctgccttggcctcccaaagtcctaggagtacaggcatgagccatcatgcctggactgtagcacttcttgggggaagaaaatgagatgtggtatctcatttatgtaaagccagacccaagccactgacagttttagcatactgtacacagaaaaaggaaaagtccaggtgggcagattctctgcactgggttgtaggactcatgggagctctggggaaaataccttctttggcaggcattctgagcacagaggacatttcaaagaattaattgtcaaaaaccgttcctttttttttttttttttttttttagcaaaagaagaagagaaacagaagttacttaaatggagttcagatttaaaacaagaacgagaacaactagagcaaaaggtgaaacagctcagcaattccataagtgtaagtaaacctcatgccttcagcagtcgatacataggtgcagagacctaggcctttccaatatacgtaacagtacgtgtgggccccaggctgtttcgggtccttctgtttattaacgtgattaacttgggcaaatgcagtttgccatccagttagagttcagacctcaggtacaggcggccagttggtaggtggtgccttacccaagctctgtaacatcctcttggctttaatcagagagaggattttcagtcttcaggctgaataagtaacagctacaacagtgtagccatggccctgcgtattcctgacagtgtgtggggggagtgtagcgcctcacctgacactgagcagacacagaccaggtcccctcgtgtgattcttcctagtcacctgagcgagtgggcccatccgtacggccctccctcgctctttcttccacaccatgctgattgcatttcccggttttcctgaccagtgtgaggaagcgggctttctagagacaagtattggaagtaagtactgcccagcccggcctgtccaagtgggaaagagggttgtatttgcagcagggggacagaggcttctcccaggcaaggagccagtcttcttttccattgagtaggtcacccttgttggagtgaagtgacctcagccctcatggataccaggtggtgccttgtacttggtggcagttgaactgtcctgcttacctgctttctcctcctcaccatacctacccatggcatgcagatttaacacctctttcctctctttccctgcctaaaatagaagccagcaggtgtgggaagctgagggcaaaagggcaaaagactctaagtccccggctgagcagaaggtgtactggctgcaggcctttgtccttggggcttcgatcctcctaaatgctgctggcctgtcgtctcacttcctgctgccctcagatggaatccagatagcactgtgtgttttccaccctggagagctcagtccagtcctgaaggctccccagttagcatgacagaagcatatcaaaacctgcctaaacaggctgcaggacagctgtgggaactttttttttttttttaaacaacctttgtttggaagtctgatggcggctctgccggtttgtttttaagcgttagtactcctgtgtgttggtgcccgcatgctctttctccctctgttgcctctgggacctgggaccccccagcctacccactccacccgccctgttccttaggtggtagccgcccactccactgaggaacacagcaaggcccaggggctgcacagcagccagcagagcttcttctccctgggcagagagaaggcgctctgctcttaggggctgccaggcctgttagaaaccaggcggctcagtgccactgcccttgtcatttgctgcagaaatgcatggaaatgaagaacaccatcctggcccggcagaaggagatgcacagctccctggagaaggtaaaacagctgattcgcctcatccacggcatcgacctctccaaacctgtagactctgaggccactgtgggggccatctccaatggcccggactgcaccccccctgccaatgccgccacctccacgccggccccttccccctcctcccagagctgcacagcgaactgtaaccagggggaagagactaaataacagagcccctctaggagaagccacgggatcccggcggcaaggagaacagaacactgaagactctagaaaagcaaagccggatttctggaaagtgcagaattcttttggttctttggttccagagagagagaagatgcttgtgccaggtggcaccagagtttgccaattgatccttcttattctgtgtgtacatgcaaagattggaccatgttacatgaaatagtgccagctggaggttctttgccagcaccatgccaagtgaaataatatatttactctctctattatacaccagtgtgtgcctgcagcagcctccacagccacgatgggtttgtttctgttttcttgggtggggagcagggacgggcggagggaggagagcaggtttcagatccttacttgccgagccgtttgtttaggtagagaagacaagtccaaagagtgtgtgggctttcctgtttctaaactttcgctactataaaaccaaaaaaaggaattgagatttcaccaaccccagtgcccagaagagggaaggggagtggctggagggagcagggggtgggacagtgtatcaaataagcagtatttaatcacctctggcgggggcctcgtgcaaggggagactgacaccaagaacagccagtaggttcttctcccctgcactctgctccctgcgcggtaaccccaccactcctgaagcctgcccagtctccttccttccctgcttggtgagtcgcgcatctccgtggttatcccgctgtctcctctccaagaacaagcagagcccgggccactggcccttgcccaaggcagggaagaaggatgtgtgtgtccaggaaggaaaaaaaggtggatcagtgattttacttgaaaacaagctccatcccttttctatatttataagaagagaagatcttgagtgaagcagcacgcgacccaggtgtgtgtgaattgaatggagacgtttcttttctctttctttaatttttgtttttgttctttttttctttaaggaaagttttattttactgttcattttactttcttggtaacaaaaactaaaataaggaatagaaaagctgtttttcaggctgacagtccaattaagggtagccaagaccttgcatggtagagtaggaatcatagtgtcagtgaggtcccgtgagtctttgtgagtccttgtgtcatcgttcgggcactgtttttttatgcaagggcaaaaatctttgtatctggggaaaaaaaacttttttttaaattaaaaaggaaaataaaagatattgaggtcttcctagtgttacttaaattaagatcaaggtaagaaacattgtaaaaaaaaattacaaaagtgctatttgtttcctaaaaacagtgatttctattaaaaaggtgtcagaactggagaaaa

SEQ ID NO: 15029 - DNA, 3188 bp, Homo sapiens
  misc_feature (2827)..(2827): n equals a,t,g, or c
gtgtgtgtgtctctagactggtgggccagtctccttgaaggacagaggcggagctccccacccttctctctcctcagaaaagaccgtgctctcttcttggtgcagggatcttgtctcctgttgtgaagcccaaatggaagcgtggatggtatcagggccctacccgtggtcttctcagattctgctagagcaaaaggctggtgcctaaataagatcccttcctttggtgctgcttttggtctttcagccaccagcattatgagtgcctgggggacacctccgagggaactggccagcggagctctgtggtgcgcacgcaccctggccgtgacaggagggtgcgggagtacaggctggctgcatcagcccttggtgcttagaacagaggaggagtgacatgttttgagggtacgtctctgagacagagccccagcgtggccttcgctctgtcttgcctttggggagaggtctgaagctcccactcctttctctgcctgttggctccaggcaccagaaatttactccactccacccacccacaagcctcctgggtgaccctgggctagaattgctgcgcttgcctcggcttggccggttgtggcctctccttgagaaaaccagggttgtgaaagactcagaccattctctcatcttgccttgtcagaagtaaattgtgtcagatttgtgctctcgctggagacctttgccccttgcgtgcccctggccgatgggagggcggtggaggctctgtaccctggccctgctggagcatctcccccaagcccactccaggccctgggaatggccagagtctaggagaggtagaaacgatcctatcagcttctctcccacccaattaggcccagagagacaaagacagatctgaaagcaaatgcaacagagaagagacacttcttagagtaaaatgtgtctcatctctatcagccatcgcctttcatcttcccaggggcctcagaagaaggaattaagttaggctgaacaggcctcagagttaggccctggctgcttgattggctgagggggaaagagttcccttttctcattcagaaaccaaggtgctgtgtctagtcagggagccttggagatgcctggactagttggaggaatcgttggcagaggatcagagaccagcagcaggctgtctgccctgtctagagctcttcccctcaacttgtctgggcccatctgggggttgccacacaacacctaacttaccttttcctgaaagaagttgggaaaccatcatcactagaggcctttgctcagagaggagctgccttaggagtcttgggtcggaggacggggctaggaattgaccagggctttgcctgccgccctcagcagtgtcgggtacattctgacctcgcctgcagctgggctgtggattcttcctgacattcagatgtgagctgttttgggagtcagctagtatggagtacgagatgcaacccagcccccaaacctacattctgcactcaaattccaaaacactgctttactgtaaagaagaggcccctggcacccaatctccctgtccttcactgtcccctcagacctgggcggggaggggggggggcctgtgaccacctgagacatacgctcgggacactgccccaccccagccacctccacttgcttcctcctccttccctccgctgctctttccccacggcccagaatttagctgctctgacagccacttttgagaccagctggctttgtagtcacttcaaagagctggagcggctgcccactgggccctgactgggagtcccctgccagctcctgatcaggcgctgcgccctggtggcagtgatgactgggagtcccctgccagctcctgtccaggcgctgcatcctggtaacagtgaggccatgttgctgtcatctccacctctgcattcttgctgcctgtgggtcctttttctttcatggagcctgctgggtcttgtctcacctgtgctgagctcctctggggttttgatttcttccttccttatcaggccctttggggtaagcctgctggttgtacctgacatagggaggcagttaggggcagtccctggtggggccgccctggcagcctccagctggcaccatcgtgtgcctggtttccctgcaacacctgcctctctgtccctgctgctgcttggctcaggcccaacaggcagcgtgcatggaggtggttacacacagctgtttccgtgagggtgaccgtgtctgcagcacgcttccgtctccgcatgcacggctgcctctccagccacctctgatacttctctcttggggccatcagagcctcccttgggctgtcacctcccagctcacacacactcttcagtggtttcctctcttcattctcttatagggcgtggtccttcttatttatctaaagggctgaatttaggagactttttacccaggggcaaaaggctcttagggtaatgagatggatggtggcccaggtgcattttccagggcctgggttctccagatcccgtggcttctgttgagtggaggcaactttgctctgtgtgaacctcgcccctgtccctctgccgggcacccctggcaggaagcaggactcccatcctcaccctgacttagactgtcctctgagtcagctcctctccaagacaggagtgggcagccctgggcagtcttctggccccttgctaaagtgaggggcaggaagctggggctgccctccagaaagccggggtaggaactctgaaaaatacctcctctaaacggaagcagggctctccagttccacttggcgccccctcccacaaggcccttcctnccttgaggacccccaacccccccctccccttccccagcagcctttggaccctcacctctctccggtgtccgtgggtcctcagcccagggtgagctgcagtcaggcgggatgggacgggcaggccagaggtcagccagctcctagcagagaagagccagccagaccccaaccctgtctcttgtccatgccctttgtgatttcagtcttggtagacttgtatttggagttttgtgcttcaaagtttttgtttttgtttgtttggtttttgttttgagggggtggggggggatacagagcagctgatcaatttgtatttatttattttaacattttactaaataaagccaaataaagcctctca

SEQ ID NO: 15030 - DNA, 218 bp, Homo sapiens
gttttcttagtcactgttgttaatctcttattgtgcctaatttataaattaaactttattgtgggtctgtgtgtatagaaaaacatatttatagggttcagtacggaggtttcaggcatccactaggggtcttggaacatattccccaaggataaggggggactattgtactgtccccacccagggagccttagctatgtggagtgagtaggggcatg

SEQ ID NO: 15031 - DNA, 795 bp, Homo sapiens
gtcctgatcaccgcactcctcatcgtcctcacctaccctgcctggaccttcatcgactgcctggactcggccagccccctcttccccgtgtgtgtcatagttgtgccattcttcctgtgttacaattaccctgtttctgattactacagcccaacccgggcggacaccaccaccattctggctgccggggctggagtgaccataggattctggatcaaccatttcttccagcttgtatccaagcccgctgaatctctccctgttattcagaacatcccaccactcaccacctacatgttagttttgggtctgaccaaatttgcagtgggaattgtgttgatcctcttggttcgtcagcttgtacaaaatctctcactgcaagtattatactcatggttcaaggtggtcaccaggaacaaggaggccaggcggagactggagattgaagtgccttacaagtttgttacctacacatctgttggcatctgcgctacaacctttgtgccgatgcttcacaggtttctgggattaccctgagtctcaaacagttggaaactagcccactggacatgaaagccaagacataggaaagttattggtaggcaaatcttgacaacttatttttctttaacaacaacaaaaagtcatacggctgtcttgctactaccagataaatgatgctgctgtgtgaaaggaagaactgtctcatagcggtcattggtcgtccgtggtggttggttgtgctacagttgaacccaggctaaagaccataatccggatctttaaaggcacaca

SEQ ID NO: 15032 - DNA, 3465 bp, Homo sapiens
ccgcgccccccccccccccgcccggcccctgctcctctcgctgttgcacgggctttggatctagtcatgggctggcaggaattgtggcctggcttaggaatagctatgagccccactgggttctggagagccagtagagatggggtgatctgggaggctggaggtagagcctttcttttccgttacaaccttgcctagcatggagttatttctaaaatgggaactttggtctaggagaaggggtggcaccatatgaaacggcattccttggacagggtgacttccttatcgtttatttggtgattttttgttttgttttgtttgagacaggatcttgctctgtttcccaggctgtattacagtggcacaatctcagctcactgcaaactctgcctcccgggctcaagcaatcctcctgcctgagccaactgagtagctgggactgtaagcatagaccaccatgtgcccagctaatttttgtagagacagggtttctccatgttgcccaggtacgtctgaaactcctgggcttaagtgatccacccacctcagcctcccaaagtgctgggattataggcatgagccactgtgcccggcctcctccttgttatgatcaaattagactgtgcctggttgggtggtaagatcactctgaaagaaagctcactgtgaagagatgaaaggtggaggcagagctgtgaggtcatggggaaaagcctgctttccttataagtcctgctgttcatgttggaataaggatctgctcttccttgtttccatgcattttgcaggattccaggtaccattaccacactcttctgacccatgaaaccaactggctgctcacacatcaccaaacaggttgggggttagccttcagcacaggtggatacatctgggattcactgagattcctgccctctcctgcttcctagtggtttgggacaggccctctgcccatcgtcagcagttttttgctttcatacaaacctggaaggcactggcatctgcctaggaaagtggatctgtgaagaacagatgaactcaatcctttctggagtctgacaaagaagggataggcttccttgacattgcctgtcctgacaaggcctccctgacattactcctccaatttcacagttaccttctgtaaatctattttctcatctactgaatagaatcaggcgccctttttgtcttcccacctcttatctcttggcaattttaaggggaattaatgcaagaacaactttagtgtctcttgggaaaacaagccaaccaaatacaaaacccattaagcctactagggtgagtcctcttaacatgggaaggcgatgattatgcaaacaccggagttccctcctcttcagttcctaagaataaagaacaggtatcaagaactttctttaaagttagtgtaactatagttaacaaagtatccattgaagtttagtgcctgtaggactgagccagtgctttatcaacccaacacatcatcaccatgtgcatactctagaaaaaaaaatagcttccttaaaagttacagaggctcttaacgtgttaaaaccgaaaaatcacatttttcttgatttcaaatatgttctacggccttactgttgggatgatatttagtatgtaacttagcattccaatttctcaagaatttttaggccgggtgcggtggctcatgcctgtaatcccagcactttgggaggccgaggtgggcggaccacgaggtcaggagatcgagaccatcctggctaacacggtaccccgtctctactgaaaatacaaaaaaattagccggacgtggtggagggcgcctgtagtcccagctactcaggaggctgaggcaggagaatggcgtgaacccggtgagcggagcttgcagtgagccgagattgcgccactgcactccagcctgggcgacagagcgagactctctcaaaaaaaaaaaaaaagaatttttagcaaaacatcctgtttttacttaaaattcttctcatatttattatagttagaaggcaaagatcaagatgacctgccgtttgactgcttttacatcaaactctgcccagtatttgcagcacaactcaggggaagggccttagcttacaggtactcccagccttcatctgcccctgcagagcagtggctgtcagccggatgcggcacttttctgtattttcatccacacagctgcccagccagagttcgcaacactggatatttacaccaaataattgtggttgacttgtctgaagccagctgacaaaaggatcagcttttcccacttgtattttttaaaaagagggattgtgatcattgtcacagagtgggtgctggcctctcatatatatgatatatatatatcattttatatatatatatatatcatatacataatttttactgctgtctctagttttaagtcccaacaataggaaggccgatcagctatattgatatatttaaggctgtacttaactaatttgggctgaggatgaatatatcagccacagcacattaaagaatgagccaaggatttgtcatggttggtcactttttaaagtatttgattactgcaactggagaatgaaaagtgtatattggtgacgccaacctcagtttctgagcactcctgctctgtggtgagaatcagacaaaaattcatcggggtgaaaaaggcattacctgattcacacccttgtcttgctagccctcttccattcatttctcacacagcactttgctctgttaaatcctctctctgtctcagaccattgcttgccccttcaaagggtatggttcaggctcctttcaagacatttggagtttctctctggggaaagagagccccctactggtttggcttcagtctaggtccaccatccctctcgatctggcatcttggagattaatttaaaaggcaagctcaccacaatgtaagcctatggtctggccaaccttgcttttgggaactgtgacaccaaagcccccaggactatctgcctctccaggagccagatagaatgacatgcctttttcctaattgtccacattccacccccaacccactgccactgtgggccaagccatccatcttgcaatcttcatctaaaacagctctcatttcatgccagttttgctcaaacctgcaccgtcacaagatattcagaagatgaaaacgtagaagacacccctgaattaaaaacacttacatagcagtggctggaattactccaaaacgtgcccagtgatcgcactgtaacatgggattttctcacccaaataggcaactcatgcttcctgagtgtaatcaaagcatgtggtgttttggggccatatgcaccaggtttctattttagaaaccttcagctgtcttgcttatgtactgtatgtaaatttattctttttaaaaatcacttttatttgattttgacttattaaatgctttaaaagcca

SEQ ID NO: 15033 - DNA, 10995 bp, Homo sapiens
gcgccattccaaacatggcggctccactagggggtatgttttctgggcagccacccggtccccctcaggccccgccgggccttccgggccaagcttcgcttcttcaggcagctccaggcgctcctagaccttccagcagtactttggtggacgagttggagtcatctttcgaggtaatataagacatgggcgtctttgtccctagccttcccttttttctgaaacgtgaactgcgcgtacgcgtatctcctccagggatccgagcaactaattcacaaatggggaaactgaggcttaaagtaagtcacttgctttaggcttccccgtggcccgtattcaattcaggtctgctggcgggggcgcgtaaactcgacgtttgtggaaacgtgaacccgaagtttgcctaaaccccaaacttggaacccttccagattcccagccggtccttagtctcatccccgagcaccgtttcttgcatccctgcatgtttagtaagaggctcaagccttttcggagctgagagtttcactgctgtatcctgtatcctttccgctgggcttcacctttaaacgatcctaaagggactcttaagagcggaaattgacttaagttaccaggcgcagcttggtactaagagctgaggaaggaggaatgctggaggttagggagggagggaggcacaggtgacccaatctctcagttttgcccaaggagtttaccttgtagcaagaaaggtgaactgtatattgagggaagatagagaggtgaaaataagtgctctggtgatttccagtagtctttaaagtggaagatgagctattcctgtgtagtaataaagtaatgtacgttcaaattggagttaacttttccacattttaaatcccagttttgccgggcgcggtggctcacgcctgtaatcccagcactttgggaggccgaggctggcggatcatgaggtcaggagttcgagaccagcctgaccaacatggtgaaaccctgactctactaaaaatacaaaaattagccaggcgtggtggcgtgcgcctgtaatcccaggtactcgagaggctgaggcaggagaatcgcttgaacctgggatgcggaggttgcagtgagcggagaccgcgccattgcactccagcgtgggtgacaagagctcgactccgtctcaaaaaagtaaaataaaatataaataaataaaaatcccaactttgtgacttttgtattgtatctaatagcacagtggtaaatgaatataatttgcaagcgattattcagactgcatggacaaaatgcttttaccacacggatgtacaaagatttagaaataaatgatttgagatggagtctcactctctcgcccaggctggagtacagtggcgcaatttcggcttactgcaacctccgcctcccgggttcaagcgattttcctgcctcagcctcccgagttgctgggattacaggcacctgccaccatgctattttttttattttttagtagagacagggcttcactatcttggccaggctggtctcgaactcctgacctcgtgatccacccgcctcggcctcccaaagtgctgggattacaggcgtgagccactgcgcctagccagaaataaatgatttaaaggacagaccgtttaggaggaggaggaggagacacctttgaggtggtgctaagtggtaaaggaaggggctggtgaactttagagcagcatctagcattgtgcttgaggggagctggctctcagtcatgggcacttgctgaaagactggccctgtacaagtcttagccaaagttgactcccagcaccctgctgcttaaaaacgtacagtggctgcttgttgcccttgagataagatcaagatgtttagtgtggtctcccaggctttgcatgttgcgttctctccttcagactcgtttccttactgcagccacacaagactttcccacgtgtaccatttgttttctctttgggcttccaggccgctcctcagctcactgcatcacttcctcagtggacccttccctggccttctttttaatacttaccattaaattcggctccatgaagtcagagactacctgttttgtacccccacccctcacattgtgtaacctgtagtgctaatacagtggtagtagatagcaagtgctagatgaatatttgtcagacattgaaggaatctgtagtgtggagcctgtagtgtagttggcttgtgcacagaactccttgcctgattcacatatatgtctgtaggtgcccttgagagagaactccctctgggacttgattatccatacagagaatacagagaaaaccagtccctgccttcaggaagcttgtaataaacggcaggcagttgccttgttgtaggatcactgctctgatagaagaaacctggggtactgtgggagcacatataggtgtggacatcaaagaaggcttcccagagagcaggaaagccaaagaagcattttgacttagccaggtgaaggggagtgggagtggtgcgagctggatcctctctgctgctgggtgatcacgatctgtctagtcttgtctcacgattcaattcaaaggccacattttctttggaacttttcctgtttccttccttgtgttctgtgtggacctcaattttcacagcctccagtggcacatagcagcacctacttacctgcttctcattcctattggggtgccactccttgaggtctctgtctgctcattctagctgcttagcacatgctctttgatggaaggaatttattgagctcatgcactcttgattttggagggaacgttggagaccatctagttccatttcctccattcataggtagagaaactgaggctcagtgagggcaagttacttgctgaaagccagccgttgggtttgtggaaatgaggacaagcacttactttccaggcaaaggctctgttttagccatgcttttaaaaagctgttctctttctaggcagatgcggtggctcacgcctgtaatcccagcactttgggaggccaaggtggctggatcacttgaggtcacgagttcgagaccatcctgggcaacatggtgaaaccccatctctaactaaaaatacaaaaattagtggtctctggtggcacacgccttaatcccagctacttgggaggctgaggcaggagaatcgctgaaacccgggaggcagaggttgcattgagccaagatcgtgccactgactctagcctgggcaatagagtgagactccatctcaaaaaaaaaatatatgttctctttctaagctaccacacattttcttcttaatacagctgtccaactgtctataaaggcctgtgtatcttttttttttcttttcttttcttttttttttttttttgagacagagtctcactctgtcacccaggccagagtgcaatggcacgatgttgggtcactgcaacctccacttcctgggctcaagtggtcctcttgcctcagccttccaagtggctgggactacaggtgcgcaccactacgcctgactaatttttgtttttgtagagacagggtttcaccacgttgcccatgctggtcttgaactcctggactgaagtgatccacccatcttggcctccaaaattgttgcttacaggcgtcagccaccatgtcggaccctaaatttttttcttgagtgggtggagggcagtaaaattcttgagatgagatttcctgccaccctgtctggtaggcctcctggctcaggggagctggcccaacttttttggccagtttgtgactggttggcctattaatgggatgttttccagtagccataggtctcacaaaggaagtacatcctacccacatcccaaacccaacaagagtcaactttcgttttttttgagacagattctcgccctgtcacccaggctggagtgcagtggtgcagtcttggctcactgcaacctctgcctcccaggttcaagcaattctcctgcctcagcctcccgagtagctgggactacaggcacgtgccaccatgcccagctaattttttgtatttttattagagatggggcttcaccgtgttagttaggatggtgacttcgtggatctgccttcctagttaggatcctgacttcgtgatctgcctgcgtgggcctcccaaaagtgttgggattacaggcgtgagccaccgtgcccagccaggagtcaatgttcaaagtaatcctgagaatgggcaatctgtttttctgatttactttctctgtaaatcaagcgcgggagctgcaggcaggcagaatttttgctcgttaaagggccctcacatgtaggtaatgttctaaatttgagctcagatctgtctgcctcacaccaagtgtagtttgctgattgctgacagagctccactttcctgtgtttgaggcttcttttctaactccttttccaactgccatgctgttctctttctgtgcctccccaatctccctgcccacttcctgcagtgggcctgctttggtacatttccttagagttgcttgtgcacagagctccttggctgattcacatttgcatctgtataggtgccctttagagataactctctctgggacttgattatccatgtgataccaaccttgtcctcttaggccatccagtcagtaatatgtgttattaaacacttcccttgtgccaaggcagtgttccaggcactaggaggacagtggtgaataagacagacaaaattctcatctactagtaggggacagataataatggatgaaaataatggatatgatgtcagttaattatgtgaaaaacaataaaactgtgcttgggtgtggagcatgagcaggaggggcacagtttagaaagggtagaccggctgctgtctctgagggggagaagattgtcctgagtcctgaatgggtggtgatgtgagttgtgtaagcaccagcaagaggccacagtggggctggaagagtgtctgggcctggtgtggaataagatacagggaaggggcatgtagtaggacagagaccagatgtggtgccggctcgtttgcctggcgcttcctccatgggcctaattaattggtaaactcagtttaccagatgtttccattggcatggtgtcttgccatctcatatgcaaacacagatgctgccacctcatcagatgacttcaggagaagttatttcttcctctggagtaagatttttgatgtataaatgatatttttttctttcctatgttttgattacacaggcttgctttgcatctctggtgagtcaggactatgtcaatggcaccgatcaggaagaaattcgaaccggtaagcattccctctgtgtacacaatgttctgggcttcagcagtatttcctagttgctaattttatacttcatgtgtttcagtcctgcttttatcctaagacaacatttcagggactaaaatgtgtgcacataatctctatgagctgctgatttttggttcagtttattaattgacatatcacccataacgaatcatttataatgaacttttcgtattcgtactaggtaaagaagaagaccaatagtgtgtactgctttttaaaaaaattttattatttttggaataggtcttacagagaaaagtctcttgtgcttctttttattccccaagttctgtccctaaaggtaaccagagcttctgatttcttcgtaccatattttacatgtttttttttttttttgatggagtttcactcttgtcgcccaggctggagtgctcactgcaaccaccacctcatgggttcaggcagttctcttgtctcagcctcccgcgtagatggaactacaggcatgcactaccatactcagctaattttatatttttagtagagacggggtttcgccatgttggccaggctggtgtcgaactcctgatctctggtgatccatctgtctcagcctcccaaagtatcgggattacaggcgtgagccaccgtgcccggccttatatgtgccattttaactgtaaattatgatgctgattgctggatctctgcattgtctctttttttttttttttttttttggagacagagttcttgctctctcacccttttaagaaaggagtgcagtggcatgatctctgctcactgcaacctctgcctcctgggctgaagcagtcctcccatttcagccccccagtagctgggaccacagtgtgagccaccacatttggctaatttttgtttttttatttttttgtggagatgggatcttgctgtattgcccaggctggtcttgaactcctaggctcaagcagtcttactgcctcagcctcccaaagtgctgggattacaggcgtgagccaccacgcttggcctctgccttgtgtttttttttttttttgagacggagtctcactctgtcaccagtctggagtgcagtggcgcgatctcggctcactgcaacctctcactccctggttcaagcgatccttctgcctcagcctcttgagtagctggattacaggcatgttccaccacgcccagctaatttttgtatttttagtagagatggggtttcaccatgttggccagggtggtctcaatctcctaacctcatgattcgcccacctcggcctcccagagtgctgagattacaggcttgagccaccatgcccagctgcattgtctttttaaagaagatctcatggcttttatgctatattaatatctctctctttttttttttaacctgagaaaagcataacttatctgctgtttaatgttggttaacacatgagaagttgggggttatgattactgctgtggccaagattaaaatccctgagttgtctatgagagggctttgtttttacattctgattattcatttatgagggagataaatgagtctgttgtttttcttattttaataattttgttcctttttttttaaggtgttgatcagtgtatccagaagtttctggatattgcaagacagacagaatgttttttcttacaaaaaagattgcagttatctgtccagaaaccagagcaagttatcaaagaggtatgaactcagttttctcctcagctctataggaagaactaagtggtgccaggattccttttatgctttaaatgagatgtaaccgtttcctgcgagtttcattcaggctttataggtcagtgtgaaatgtggctagtcatccatgtttgggacaacctgaacaagaagtaaagccaaggagtggggtccgaaagcagagtgtcagacggaacagctctgatgtgacttgtgtcatacattggccttcaggaaagatttttcttaaaagattctgccatgtgaaaaaaggacaaaaagccactaacatataggcttgttttggacaaaaactgagatctgtgtccccacttgccttacccagtgccttgcacacaggaatccaaggaatcaaaaagtagtgttcgacccaggttcctggaaactcaggatttcgttgatctcagttgttctaagctagggcatttggaagtgtgttggggttgccacgatgacttgggaagctttaatggcattgaatgggttgggccaggacctgccccatgtgatgtggaagagtgaagaatcatcctgcccaaaaagccggcaatgccctcagtgagaaacactgaattgagattattggttgggggcaatttttgaagtaactagtcccaattaatcaaaaagtctcttttcattcatgataccagctgttggggatagctattcttacagtttatcatgtcagatcatttcctgatgtgaatacttgaataacagtgcaggtatgtccaagactggatggttagtaaaggatgtaatgctgttcttaaaaagctcttgaaaatgtaattttaacagttcataatctgaagtgatagatcagtggtgtggattttcttgtaaacagttgttaacaaatgtttcagattttcagtgttttaggttctcagcagtagcctttggagagaggtactggatggctggggaccaggatgggatagagtctgtaattagtctgttttcaccctgctcataaagacatatctgagactgggcagttcacaaaagaaaaaggtttgatggacttacagttccatgtggctggggaggcctcacaatcatggcagaaggtgaaagacacatctcacatggtggcagacaagagaagagagcttgtgcaaggaaactcccatttttaaaaccatcagatctcgtgagatttattcactaccaggagaacagcatgggaaagacttgcccccgtgattcaattacctctcaccaggttcctccctcgacacatgggaattgtaggagttacaattcaagatgagattgggtggggacacagccaaaccatatcaatctgatttctttttggctgcccttttgaattttgtaacttgcatattactttctataagaaaaataaacgtaggccgggtgtggtggctcacgcctgtaatcctagcactttgggaggctgaagcaggtggataacttgaggtcaggagttcgagattagcctagccaacatggcaaaaccgcatctctactaaaaatataaaaattagctgggtgtggtggcgtgtgcctgtgatcccagctactcaggaggttgaggcaggagaatcacttgaacccgggaggtggaggctgcactgagccgagaccgcaccactgcactctagcctaagtgacagcaagacttcgtctcaaaaaaaaaaaaaaaaagcccataaaaacttatgttagaatctgtcatctgggttaatcaaatagtggagccaagcagagtaatgggcttaatatggtttaatggattctctttgttttgaattgttagcctcttaactaaccagaaccgtatgtgtttttcctgcatttgctctgacttagtccatgactttcatctgcaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattttttttttgtctttagcaaagtttagactgtgaatatgatgacacagattcttttttatggtggctttgcttgttttaaatttttgcatgacttttcatctttttatgtgtgtttcctgtagtttgatccgaaggaaaagagtatagtagcctgagaatcaggagatgggagttttagtcgtaggccttatgataattaccccgcggtggtgtgtagaaaagtatgtaaatttgctctgttttaagactttgaactacctcaagaagaggaatctaatacaatatttgtaatgtttccagagctctcagaatgaggatttttttgtaaataggtcagaagacgatggaactgtcctgggttagtatagtaatcttacagtaggatccttaggttgatgctgacttctgtttggggtatgtttatattttatgtggtgtttactttttttttttgacatagaaggatatagtgggagcagtgatacgctaacattcattacattctgcagtaatgaatctgtttaatgggtcagtcactgttttcagtagcatgacagtggggtcataggtgagctgtgaggggctaaatcttgctctgattgtctctttctgttttgagttttgtttgcgtgtatcatttttgttctacattttgggaggggaaacattttccgttaaggaaggttgttgccagtggatttgactccaagggactagagtgtcgtggtgggggtggggaggggctgcagggtgatcattggctactgagcctccacagagagcatgtggtgccctgcctttgggagggtattttgctctcgttagttttgtgggcagcctcagattccctgttgagttgctgttaagaaatggagatttctggctctcattgggtaaggttttctgagttttatatcttattagatcacatccctttacccagaacaaatgcttcactgtcttctgattggcagtactcctgtggctttgtgccttgactcattttgttgtcttcagccttgaaggccccttcccacatggactgacatccactcatgtgcctgatccctgaagcctcccagcacccattcagttgcatccccagggcacaggactttgatctcttctgttgccctcgctaggttctccctggtgggttagtgctttgtatctgtctctctgcccctcactaattctacacccatgagaattagacattattctccttaaatatataaggaccatataatctgtatctttttggtgtgtgtatatggtatctggcacatggatctctgattaccagcctgacatcaacaaatcccctcagttacaacgtataggttaaacaaagcttttaaaagctcatgtggtatgacctcaaggttgctaacctggtcactcatggtaattagaaactctgattggcagctttgtatttcttgactaaaaacctaaataaactgattaggttttaggcgttctttcaaagaggttcttgagaagattgagaactatcctatttggtgcttagtgaaaagattttgaattactgtacgtaccagttgttgccatttctttattaaattcagaagtttttttgccaaataacaatttt

SEQ ID NO: 15034 - DNA, 1986 bp, Homo sapiens
ctcaaaaaagaaaaaggagatgttgaatgggaagtcagcaagggtgctagaatgtagcaagtattcttcaggtgttagtgatttctgttgttcgggaagaggagggttatggaggaagagtatgggatttaggtgggttaagtgatttgcccaaagtcaagaggttagtctttaacctttggcagaagcaggatttgaagtgagttttcacacccctcttccctggtcagtgtgttgataacagcccacccacctgtggttccagggtgttcttaagaagccaaggttgtcttgggtgtggtagctctttgaaaggtagaaagttccaccaagaaggccttttttcttgaatactgcttagcttccttgtcaggctccaagatgcagattgcctgtgggctatctctctccacagataaacctactcacatcttcaggacagccttttttttttgagacaggagtcttgctctgttgcccaggctgtagtgcagtggcacaacggggtcccacaggcaagtgctggggaaaggcccacccagccatcaggtagcctgtgtgttctacaaacagcagctggcagcactgtctcctgccggacattcctgccacccgacatcaaagctggtgggtgaccttttcagccatttgacattcctcccagaagaacctctgcctcccagaggtttaagcagttctcctgcctcagcctcccaagtagctgggctatttttttttttttttttttgagatggagtcttgctctgtcgcccggttagagtgcagtggtgcaatctcggctcactgcaacctctgcctcccgggttcaagtaattttcctacgtcagcctcccgagtagctgtcaggtgcacaccactacacccagataattttgtatttttagtagagatggggtttcaccatgttggtcaggatggtctcaatctgacctcgtgatccgcctgcctctgcctcccaaagggctgggattacaggcatgagccaccgcgcccagccttaatttttgtatttttaatggagatggggttttgccatgttggccaggctggtcttgaactcctgacctcaagtgatctgtccgcctcagcctcccaaagtactgagattacaggcatgagccaccgtgcccagcccatcttcatcttctttacttgaacttaattctttttcatgcatcttcccttctttcctcttttctcctccacccaaatgtcttaactgttaacattcccaggtgtttggtcctgggcctctggaggttgtgaaggagcactgctcagtcctcccttcaagaaagcagcttcaaggagttcaattacaaaagctcctggcattggggacctgccgccatgttcctgcccagggcatgctggtcctggctgtcaccaagcacagtggaggtcaggtgctaggccatttctgcccgacacaggcctcctctaatgagcagtctgaggccaggcacaggaggctgaggcaggagaatcgcttgaacccaggaggtggacgttgcagtgagccgagatcgagccactgcactccagcctgggtgacagagtaagacttcgtctcaaaaaataaaaaataaaaaaatactgagcagtctgcttgggcgcttccatcagcctggccatgacatctttggagctgtcctgccctcttttgccccggtgttccttggcccacctgtcagacctacatcataggctcttcctgtcttctgtttcctctcccctttctctaacataggtgtttctcctgagaaagaaaaaaaccacctgtccctgacattcagaagctgacaacactgttcggtcatgccattctcctgttggacataaacagtctctgaatgccaaccccaaagttgctctcaggccatgataaaataaaccacttaataattttgtctaagcacgtacaaagaaaattcaaggtcagtttaccactcacaaaataccaaa

SEQ ID NO: 15035 - DNA, 593 bp, Homo sapiens
ggctgaagtagggggattgtttgagcccgggaggtcgagccctgatcatgacactgcactccggccagggcgacagaacgagaccctgagaaaaaagaaaagaaagaaaaaaaaagattagcatagtgactttctctttgatgtaaccataaatatttaaagacatcagtgccgggcacattgggaacctcaacaaagttgtttccgttatccatctccgaccagaattcaggaagaactttgcctgtcttgttcccgctataaccaatgactcaacaaatgtttgtggagtgagtgggtgaccctctccttttaccaacggtaaacagcccgcggaaagaaaaagtgacttagccaaagtctctccaggcatttggggcagagtcgggactagcatagtagtatcctgactctcgcaggagggctcgctccactgtagttattaattctcctctccacacaaccaggtctaatccggccaaagtcttcaattcttaagctaagaaaaaaggaaaatacatgtaaactctgttttgcgatagacaagaaaacagaagaattaaaaatcctccttccggggtgcaccagaatcc

SEQ ID NO: 15036 - DNA, 13814 bp, Homo sapiens
gcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggtaagggattggtagcatctgtttcaggcactcgtgatgtgttgccaccccacgtgatagtgagttagagaacacagatctgcaccaggctggccagccgctcctgtaagaggccaggggatgtgtgtgtttagctttgtgggccacagagtctctgtcccgaggactccacttggccagaagcagtcccgggcaatacgcatgcaagtgagcgtggtgtggctgagacgactttgttatgagccctgaaactggaatttcatgtgattttcaacatagtttttttttttttgctggttttccagtcaaaaccctgtcatctccctgtcctgccccaaagcgtaaaaagcgttcgtcgttagaatgctctggaggtggccaggcctggcctgtgggctgaagtttgccaacctctgatatagcaacttcaaaaaacattttttgtatgtttttcttgtaattttttccttagatatgaagggaagcgtaaactgaactgttttaatagtcagtgcgtcacatgatgtttgctgtgacgttcgttgtctcctaagatgataagaccatatatcgtcgtctcctaagatgataagaccatgttttcgtggtagtttttcaatgtttagatagattttgatacacagttacttacagtattgggtacagtaatgtgctgtgcaggtctgtagtctaggagcagtggctgatgtagccgaggcctgtggggggcgctgccatccaggtgtgcgcacactccgtcatgctcacacagcagcagagtcacctgaggacctatttctcagaacgttttctctcggcaagcgacacgcaactgtttctgctttgcctccaggcagttatgaatttgagaggataccaaatcatcaggtggatcttagcaaaagaggcaagctttatttggtggttgcacttttgaaatgtaaacaaattcgtgaccaacttcagtattcactttttcgcttttttttttttggacagagtctggctctgtcgcccaggctggagtaaaagggcatgatcttggctcactgcaacctctgcctcccgagttcaagcgattcttctgcctcaggctcctgagtagctgggattacaggcgtgtgccaccatgcccggctaatttttttttttttttttttttttttaagtggagacagggtttcgccatgtcggccaggctggtcttgaactcctgacctcaggtgatccactctccttggcctcccaaagtgctaggattacaggcgtgagccaccacatctagccaatttttgtatttttaatagagacagggtttcgccatgttgggcaggctggtcttgaactcctgacctcaagtgattcacccacctcagcctcccaaagtgctgggattacaggaatgagccattctgcccagcctcgctcttattttggaaatatacgtgtactttttaaggcaaactggatctcgtgagatgtttgggaaattgggtgatgccgagcgcctttgaaatgccctggtttgtcttcattcgtatttcagagtctgtaacggttagagaaaagcatagaagtctttatgcgttaaacttttaaaagcgtagtggaagtcggctgctgggtcgagtgcggccgtgtccggcgtctgagggggttcctgtcatgctctgtgtggcctctgtcttgcaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggtaagcgtcccgccgggggggaaagcagactgagcaggagcctggtgggtccctggcggccccggtcccgttgctggcactgagcatggaccatggcaatgagtgcctgtgacggtcttactcctcccatggaccacctccccgaactttcacggcccctgctgatcttcagtgaggacgtgcgttgccggtggccagggaggctgtgtggcctcggtgggtcatctgcaggactgcctttgcagcctctgtgtcccgcttgtggaggctggccactcttggtcccagcggccggggagaacccgagaaacgcgcctggacagagcgccgcggcgcaggcgtcgtggaagaagccccgtgaccgagcagtgtctgggcgtgtgtttctctcaggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccgtaagcagccccggccctcacgcgggcagcgcttccttccgcgggcggcggcctcacgttcttcagctcatttcaattttgtcatcaagagtggtgtgaggcgggaagggtggagatgattatccccgtttcatggatgacaatgttgagaccagatgctctgagatgtgcggcacatccaggcgcagcccggctccccgggatggggtggggacgcggcctgtgtggccgagctctgcagggcgaggtgaggggaacaggtacaggggacaggtacttgtctgtcggaatccgttcatgaaccgtcgtctgtttctgtctctggcagctgataacttgagccggactcagtcaggctccagcctgtccttggcctctgcggcgacgacagaacccgagagcgttcattccgggggcacaccctctcagcggtaaggggcctgagacggccgccggcacggggctggaggacgttcggaggggcagggtgggacttcctgattaaacacggtgagagaggcttttgtaactttaattttgatataatttcacatttacagaatagttgcaatcatgtcatcaggaataccagtgcccttcacacgggctccccagctggttaaacgtggcagccttcaccttatcaccctcccctgtcccccaccccacacgtgcacacctgcttcttcatcgttttgagtccgttggagtccaagcgtggtggctcacacccatgattccaggactttgggaggctgaggcaggaggatcacttgggccttggagttccagaccagcctgggcaacagagtgagacccccccatctctacaaaaaatacaaaaaaaagttagctgggtgtgggggcatgcacctatagtcccagctacttgggaggctgaggtggtagtatcgcttgagcccaggaagttgaggctgcagtgagctgtgctcaggctactgcactccagcctgggcaacagagtgagacgctgccagaaaacccccaaaagcaaaaataaacagaaaaaaaccactccgttggagatgtctggccttttatgcttaaatacttaagtgtgtatttcctagaacgagaatgttttctcgtgttaccagttaccaaggcagcactttcatccgatttgcggtccccattcagctgtcctcagttatcccaagagtgtccctgacaactgtgttgtttccgagtccaggatctggtttggggcgatgaatggccttgaaatgccatgtccctgtagtctccttcgatccagagcagttccttagcctttctgtgtttttctggaccttgacttttggtaaccacaggtcagttatccttctggctgcctctcagtatcggcttcctgtgatgagactgaggcctcgcgctgctgattgagcagcccagaagtgagtgtgcgtctttctcaacgcagcctctcaggtgggccccgggaccgctcctgtgatgagaaagtaacttcaggagagaggctggggactggtctggacctcacggaactgtcccgcaggggctttagtgaccaccatggagctcctgctcaccgcttcctccacgcgtgttgtcagctctcgtgggagcaagggcttcccttgcccatgtgtccctttatttttatatgcacagcgtgtggctcctgctctgtgtgcacctgtgggccgtgttttcttgtctcttcacccgtctcatggctccttgttgtctctgggctttgtggcagatccctccgagggactgcagattctgtttgggtttttgttctggtggtcagttaccctggctggattcagactccagctctgtctgcctcccttgtgagagcagcagccgacatctctgagcagctgtgtccagcctttcggcatctgttgtgctcagtggagacttccctgcagggtggagctcaggccttccagggatcagcgtcactgggacccaagttttcagactcggcctgctgtggcccctccttccctaggtctcatccctggctgggcagcagcacaggtggcccaaacttcatcctctggcttcctgagccagcagcactgtgccctgtgctgtgcctgtgccctgctcacgggggcagtgcctggagcaagggcttcgtggaggtgaaccccttcggtgaagggctgactcccctctgtctgtcttcatcactccctagtgcctgaagtgtttgcttttgtattttgctcggagtgtctgtactgtgtgggagttgtggcaactcgagcccccaccgtcaccgaaagcctcctcccctgctgatgtgcttcctgtcctggttgcgggccagccccttgccagcagtggtgagaggaagccagcgcttcacctgcctgtctcttgtctgtttctgcctgcagagtggaatcgatggaagccctgcccatactgagccgtaacccaagcaggagcacagaccgagactgggagaccgcgtcggcggcatcttccctggcctcagtggccgagtacacaggtgacggcgttcgccctccttagaggtcatcgtgggcatggccatacgcctttgcgtggctctttcaatatctgttctctattttggtctaaaaagtatttttctaacaaagatgtttgatgtagtgaaagagagctaatttgagctctttggtgctgaaatgggcatgtggtttagtagaagctcttaggcctgccttgccctcctggtcatctgccctgctgtctgctgtgcagggggcagcggacctgggggcagcagagcccgggagtggtggaagtgcttggctctcaccagctgcccttggagcaggcgtgggctcagggcacagtgaactggaggtgctgctgtggctgaggtgtatgtcccggggcctttgaactttagactttttacaagttatttacctggttttgtcttttttttatagttaagacactgaatttagaaaggggataaattattgattactttgtctttagttgtctaaaaatttataacttaaaattcttttgaataaatttaagtggtttttacttcccatttttaaataatcataaatatctgtaattcagcctacccattgcttgcttctaagacattgctggttttcttttttgtgtgtgttcgtgccttaaaataataattttaccaaccctggcctcgtttcttaggtcccaagctctttaaggagcccagtagtaaatcaaacaagccgattattcacaatgccatatcccattgctgcctggctggaaaagtgaacgaaccccacaagaattccatattggaggcaagtatcatgtttcaacctcagtttttatgtggaataaaaagtgtttataaattaagggttctttttaaaagaaaacacccctaatctttgatgcatgagagttactagggagaatgcagatttcaaggaagaggccgttccaggcaggtgggagtgaggagtgccaaggtccaggggctgcagtgagcctgtgctggaggaacacccaggaggacggggcagggttcagaggctacatcctcatgtggtgcctctgggctgaggaaagacatagttctactcagtgagatagtggatgcaggtgtgggcagaggagagccaggaacccacctgcccttcccagtagatcagagcagtcagcagggaagccagggaggcagcctggaggtgaatgaggaacaggggccagggctggagcggtgggttggggaggaccgaggacggaggacggagtggtgggttggggaagatggagtggggagggagggaagaggcgcgcacccgctgagcgtgtggactccggagcacccagtgtgcatgcccagggaggggcttggaagcaggaatctgagggtcctgcacggggtctaggctggcccctgaggggcaggactgggattccaggggagaggaggcagagccactggaccctgccccagattgaggctggtgtgtggccttaagttgctggccttgggatacaacggcttgtgaatgagtgaatgaaaattatgcaacaatctgtcatccaccagaaattctgctttttaataattaagactaacccctggtccttagttggtttagttgtaaaaattaaagtgacatacggaatttctgacccactttaaaacggatgtgttcttttcttgatagtgaagatcatctagactaagaatggccccgacctaggcaggtctcgtggcactggggacagaagaggccatggtcatgcccttcctgcttagatttccacacggagaggtggttggccccctgtatcagtggcccccaggatcaccctgcatgcggagatgcactggaaggactcgtggccctcagtgtggagtcgacccagggcttagatttattccagcactgtggagggagccacagccactgggtgaagagggagaagacagaggcggggctaggccttgtgcagctccctctgctctcgttcttccagcagtggatccacagcagcctgtgggccatggaaagcccttttgagactggatgccctgagctctccttgggggctggtcacaaggcacactccctgcccagtgtgcagcagtgtgcctgacgcctgggaggaaaccagcgtcagcgtgcagaccagcagttcaggctcaggaggccctcctgtcttgccagtgagtgactgggagcgagctctgcagatagcaagttcccaggtgcccaccaagggccgcccagcaggcaggcctttctaggacagcagccctctcagctgtgccacataagctgtgggcaccacacgcttccttatcgtgcaggcagcaataagtaaataagatgaaccccactccccacagtcccgctgtcgctacaaattaaatgtttctttctttttggcatctaattctgttcatatttaaacacagtgagtagggttgaaatcagtattatatagacagttttggattcttttaaaaaatacgtattatttaaaataataaaccccattatatgctgatacattgcatatttatgaaaagtaacttttctaaagccaaataaatagaagagtggcattgacataagagggctggcatctcagccgctcgggccctccgtccattacaaccacacagcccagggccttgggaaggttctgccgcacacttgggagaggcgatgaggccttagcctttcgaggtcgagggcttgaccctgagattcctgggaaggcctcaggatgcctgggccgcatgtggagaactgtgagggcagacccaggtgcactcccattcccaggcgtgtggagggtttgtttttaaaagttaccaaaacacttgaagatacgttttaaactttaaaatacaatcaacaaacgcggcgacaggcatcagcagtttgtcatacttcagattcttcttttttttttttttgagatggagtctcactctgtcgcccagactggagtacagtggtgcaatctcagctcactgcaacctccacccctccagactcaagcgattctctgagtagctcggactacaggcatgtgccaccacgcctggctaatttttgtatccttagtagagatggggtttcaccatattggccaggctggtcttgaactcctgacctcaagtgattcgcccacctcagcttcccaaagtgttgggattacaggcgtgagccacagcgcccggcccaaacagctttatgagatatcattcacataccgtaaaattcacccttttaagttataccattcagtggtttttagtacattaatagagtagcacaaccatcaccaccgcctaatttcagagcattttcatcctcataaaaagaaactccacgcccgtgaacagtcacccccctaagtcttcccgcgcccaagctcttggcggtcgccagtctgtctccatggatttgcctgttctgggcatttacataactggcatcataattatatggccttttgggtcaggcttctttcacttagcgtgatgctctgaggtttctcagtgtagtgtgtaccggacctccattcctttttgtagctgggtaatgctccattgcatgctccgaccccatgctgttcatctcgtcatctgctgatgcacacttgggttgattcttcttcaaacattttttattgatagggaacagatgtgcatgcttttgggggtacatgtgatattttcgtttctactttttgcctgtgaagggatagtgctgttatttatatgcagtgttttgtatggatgcgtgttttcatttcccttgagtacatatgtgagagaggaattgctgggtcccacggtaactgcctgatggtttggagaagagccaagttgtttttcacagcagctgctgtgctctgtatccttctggcagtgaaagagccccatggctcgccagcactcgttaccgccctgcttctgggttccagccgtccttgtgggcatgacgcgacgtctctttctgactggcatttctctggtggctgatgatgagcatcttttcatatgcttttccatttaatcgtaaaagcattcttttcccccttgcttgcttagacttcttaagtaaagtctcaatggcatataatgctcccgtacaggggtctgctgtaattgtttacaacaggcaggccgtagctgacgggtgggagagcttcccacggagcggtgctggttgagccgctgtgggagcccaactcgtggcaattggagtggccctgaagtgtttgtctcttccccttttctctctctgcacaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattcatcact

SEQ ID NO: 15037 - DNA, 7525 bp, Homo sapiens
gagtggaatcgatggaagccctgcccatactgagccgtaacccaagcaggagcacagaccgagactgggagaccgcgtcggcggcatcttccctggcctcagtggccgagtacacaggtgacggcgttcgccctccttagaggtcatcgtgggcatggccatacgcctttgcgtggctctttcaatatctgttctctattttggtctaaaaagtatttttctaacaaagatgtttgatgtagtgaaagagagctaatttgagctctttggtgctgaaatgggcatgtggtttagtagaagctcttaggcctgccttgccctcctggtcatctgccctgctgtctgctgtgcagggggcagcggacctgggggcagcagagcccgggagtggtggaagtgcttggctctcaccagctgcccttggagcaggcgtgggctcagggcacagtgaactggaggtgctgctgtggctgaggtgtatgtcccggggcctttgaactttagactttttacaagttatttacctggttttgtcttttttttatagttaagacactgaatttagaaaggggataaattattgattactttgtctttagttgtctaaaaatttataacttaaaattcttttgaataaatttaagtggtttttacttcccatttttaaataatcataaatatctgtaattcagcctacccattgcttgcttctaagacattgctggttttcttttttgtgtgtgttcgtgccttaaaataataattttaccaaccctggcctcgtttcttaggtcccaagctctttaaggagcccagtagtaaatcaaacaagccgattattcacaatgccatatcccattgctgcctggctggaaaagtgaacgaaccccacaagaattccatattggaggcaagtatcatgtttcaacctcagtttttatgtggaataaaaagtgtttataaattaagggttctttttaaaagaaaacacccctaatctttgatgcatgagagttactagggagaatgcagatttcaaggaagaggccgttccaggcaggtgggagtgaggagtgccaaggtccaggggctgcagtgagcctgtgctggaggaacacccaggaggacggggcagggttcagaggctacatcctcatgtggtgcctctgggctgaggaaagacatagttctactcagtgagatagtggatgcaggtgtgggcagaggagagccaggaacccacctgcccttcccagtagatcagagcagtcagcagggaagccagggaggcagcctggaggtgaatgaggaacaggggccagggctggagcggtgggttggggaggaccgaggacggaggacggagtggtgggttggggaagatggagtggggagggagggaagaggcgcgcacccgctgagcgtgtggactccggagcacccagtgtgcatgcccagggaggggcttggaagcaggaatctgagggtcctgcacggggtctaggctggcccctgaggggcaggactgggattccaggggagaggaggcagagccactggaccctgccccagattgaggctggtgtgtggccttaagttgctggccttgggatacaacggcttgtgaatgagtgaatgaaaattatgcaacaatctgtcatccaccagaaattctgctttttaataattaagactaacccctggtccttagttggtttagttgtaaaaattaaagtgacatacggaatttctgacccactttaaaacggatgtgttcttttcttgatagtgaagatcatctagactaagaatggccccgacctaggcaggtctcgtggcactggggacagaagaggccatggtcatgcccttcctgcttagatttccacacggagaggtggttggccccctgtatcagtggcccccaggatcaccctgcatgcggagatgcactggaaggactcgtggccctcagtgtggagtcgacccagggcttagatttattccagcactgtggagggagccacagccactgggtgaagagggagaagacagaggcggggctaggccttgtgcagctccctctgctctcgttcttccagcagtggatccacagcagcctgtgggccatggaaagcccttttgagactggatgccctgagctctccttgggggctggtcacaaggcacactccctgcccagtgtgcagcagtgtgcctgacgcctgggaggaaaccagcgtcagcgtgcagaccagcagttcaggctcaggaggccctcctgtcttgccagtgagtgactgggagcgagctctgcagatagcaagttcccaggtgcccaccaagggccgcccagcaggcaggcctttctaggacagcagccctctcagctgtgccacataagctgtgggcaccacacgcttccttatcgtgcaggcagcaataagtaaataagatgaaccccactccccacagtcccgctgtcgctacaaattaaatgtttctttctttttggcatctaattctgttcatatttaaacacagtgagtagggttgaaatcagtattatatagacagttttggattcttttaaaaaatacgtattatttaaaataataaaccccattatatgctgatacattgcatatttatgaaaagtaacttttctaaagccaaataaatagaagagtggcattgacataagagggctggcatctcagccgctcgggccctccgtccattacaaccacacagcccagggccttgggaaggttctgccgcacacttgggagaggcgatgaggccttagcctttcgaggtcgagggcttgaccctgagattcctgggaaggcctcaggatgcctgggccgcatgtggagaactgtgagggcagacccaggtgcactcccattcccaggcgtgtggagggtttgtttttaaaagttaccaaaacacttgaagatacgttttaaactttaaaatacaatcaacaaacgcggcgacaggcatcagcagtttgtcatacttcagattcttcttttttttttttttgagatggagtctcactctgtcgcccagactggagtacagtggtgcaatctcagctcactgcaacctccacccctccagactcaagcgattctctgagtagctcggactacaggcatgtgccaccacgcctggctaatttttgtatccttagtagagatggggtttcaccatattggccaggctggtcttgaactcctgacctcaagtgattcgcccacctcagcttcccaaagtgttgggattacaggcgtgagccacagcgcccggcccaaacagctttatgagatatcattcacataccgtaaaattcacccttttaagttataccattcagtggtttttagtacattaatagagtagcacaaccatcaccaccgcctaatttcagagcattttcatcctcataaaaagaaactccacgcccgtgaacagtcacccccctaagtcttcccgcgcccaagctcttggcggtcgccagtctgtctccatggatttgcctgttctgggcatttacataactggcatcataattatatggccttttgggtcaggcttctttcacttagcgtgatgctctgaggtttctcagtgtagtgtgtaccggacctccattcctttttgtagctgggtaatgctccattgcatgctccgaccccatgctgttcatctcgtcatctgctgatgcacacttgggttgattcttcttcaaacattttttattgatagggaacagatgtgcatgcttttgggggtacatgtgatattttcgtttctactttttgcctgtgaagggatagtgctgttatttatatgcagtgttttgtatggatgcgtgttttcatttcccttgagtacatatgtgagagaggaattgctgggtcccacggtaactgcctgatggtttggagaagagccaagttgtttttcacagcagctgctgtgctctgtatccttctggcagtgaaagagccccatggctcgccagcactcgttaccgccctgcttctgggttccagccgtccttgtgggcatgacgcgacgtctctttctgactggcatttctctggtggctgatgatgagcatcttttcatatgcttttccatttaatcgtaaaagcattcttttcccccttgcttgcttagacttcttaagtaaagtctcaatggcatataatgctcccgtacaggggtctgctgtaattgtttacaacaggcaggccgtagctgacgggtgggagagcttcccacggagcggtgctggttgagccgctgtgggagcccaactcgtggcaattggagtggccctgaagtgtttgtctcttccccttttctctctctgcacaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattcatcact

SEQ ID NO: 15038 - DNA, 493 bp, Homo sapiens
gaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaagg

SEQ ID NO: 15039 - DNA, 121 bp, Homo sapiens
cgcctgtggtcccagctactcaggaggctggggcaggagaatcacttgaacctgggaggcggaggttgcagtgagccgagatcgcgccactacactccagcctgggtgacagagcgagact

SEQ ID NO: 15040 - DNA, 5476 bp, Homo sapiens
agatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggtaagtagcgggtccagggaggggttcggcggtggaggtcggtcggttggcaacagtggggtctgtcggccgactcaggggtctgtggtgagccataaccggagtctgtggactgaacggcgggagtctatgggcagaatgatgaaccatctgggagttctatggtgagccacggtggggggctccttaatagaagtttagtggggactccgtgtggcagttccgtgggaaaccatgatcgggggttcttagggcagagggataagcgggttgtaaggagtcacattgagtggtctgtagtgagccgtgacgaggagtccgtgtccgggtatccgtggacagccgcgactgggggtgggtgcgggtgccaggtgggtctatgagataaacagggaggggtgcgtggagaaccgcgatgggaagtccgcagtgagttacgcggggtctgtgaggcgccacgatggagggtcgccatgacccattagcgagtgtggacgcagggagcgggtgtcggtgggtgcgtgatgggaagtatggagcagagtaataggatgtcagaggaagggatgggggtcagtggggactgtgatggagaggttttttgggggccccgatgtgaaatctgcaggcagagtggggatccctgctgaccacggtggagttgtaatggggggatgagccgccacggtgggggctgcttaaggatccgtaatgggggtgtcctgcaggagggagatggttcagacccagagcctccagatgccggggaggacagcaagtccgagaatggggagaatgcgcccatctactgcatctgccgcaaaccggacatcaactgcttcatgatgtgagcgcgggagagatgggcggggctgacactggcagggtggggtgaggccgatgggccgcgcccctcacatctccatcgcctgccccatcctctgcagcgggtgtgacaactgcaatgagtggttccatggggactgcatccggatcactgagaagatggccaaggccatccgggagtggtactgtcgggagtgcagaggtgagggccatggatggacagggaaggcaggtggggcttcaagggaggaggaggagccacaagggggggttatggggattagtgatacacgtctgtggtgagctggaatggggctccattgtgagtaatagaagatcccacgggaagaggcagctctgccctggacaggggtgcagagtaggtgggtgggtcagtaagggagcgaagaggaagaaagaggttttgggaccattcaagccatccagtgctcactcactttggccctactctctgccccacagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccaggtgagtggctgcataaagtgaatggatgtgtaaagtggttccgtttcagccctgcctgggtccatgatttctgttctgggccccctcctgcagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggtgagcatggacagagctgggtagggtcaggtgtgggagagctggtgggtccatgcatggttagttaagtctaggcatggataaaccaggtgggattgggcctgactgtatcctgacaggtgggaaggggcctgtcatgtccagatgaatggggcatgacctggtatgctgggctggcagaacacccccaccaaccctgggtagacagagtggggccaggtgttttcaggtggtcatgcatgttggtacagatcaggcagggctgagcattcctggcaatgaggggtagcggggaggtgtgtctggggaggtaaggccaggccaggtgggtagggctagggcaaggccgccctccatccacctggggctgacctgggccttcctcctgccggcacaggaatcgtacaagtacttcccttcctcggtgagtccagccccccagggtggggtggggcatgcgggcagggcggtcagggccagtcctgagattctgccctgcagctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctggtgagcagacaggagcatccactggtggaagggtggaggttacagaagcagagagtatccctaatgaggagacagagggtatggaaggctgatatgggacatgagtaggtggtggggttgtcacgagcggggcaggtgggtcagtgcatgccctgcttgcagccctggatgagcgacacagaagagtccccattcctggaccccgcgctgcggaagagggcagtgaaagtgaagcatgtgaagcgtcgggagaagaagtctgagaagaaggtgatggagagggtaaagtggatgtggaaaggcagagggtggggttgagggagaggcagaggtcagaggctgaatggggcaagagccagaaagggctagaatggagcaagggtctggggtctggggctgactttgactccaccctgacctgacttgtcttgctcaacagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaagtgagtcattcctgagaggttcaagggagtcaggaagtgcatggtagggcctgaccacagccttctgtatgtctaccagtcaatcagctatccaccagtcaccaaacagccactacccactcacccatccacctacccacccacctgcccgtgtgtccatccagccaccattccgccagtcacctatttacttctccttttgccatttgcgtctattttgccattctcacttactgatcacctcactcattctgttgcttgctaccttccctgcagccgcatctacgagatcctcccccagcgcatccagcagtggcagcagagcccttgcattgctgaagagcacggcaagaagctgctcgaacgcattcgccgagagcagcagagtgcccgcactcgccttcaggaaatggaacgccgattccatgagcttgaggccatcattctacgtgccaagcagcaggctgtgcgcgaggatgaggaggtgagcaagcaggggcgcagcagagcagggcctgtactttgtccttcccagccttattgttccttccattccatgcagagcaacgagggtgacagtgatgacacagacctgcagatcttctgtgtttcctgtgggcaccccatcaacccacgtgttgccttgcgccacatggagcgctgctacgccaaggttggggtgtcagactgagggggcggaccatgtgggaacatcagtgggccagtgggggacagatttgttgtctgggtggtgtcttgggagggcatgcagcgcacatccacagttccctccatttgtgctcatccctccagtatgagagccagacgtcctttgggtccatgtaccccacacgcattgaagggtaagtgagggtgccacgcagtgagaggtggggggttaaggcgggggtcagaagtgggatgtgtgtggagctggggcaggatacgggcaaccagccaggacagatggacctcccttccctccctctactgccctctctactccaaatccccagggccacacgactcttctgtgatgtgtataatcctcagagcaaaacatactgtaagcggctccaggtgctgtgccccgagcactcacgggaccccaaagtaaggttttccctcagctcctcccattttgcccctcctccctgcctcgctgtcccacattcatcccttccttcctcacctcacttttccttcactttttcctctcagcttccctgctgcttcaccctccattcctccttttccatgcctcctcaccgttccctgaaccctccattcttttccttctccctccttgagcccccattcctattctcccttatcaccgctattcatccccccaacctggcctccttgcaggtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtggtaggtttctgtgcggttttggtgctgcatgtggtaggtttccatgtcggacgtggccggggcaggcggggctgcaggtgttcctgcttaggactcctgccgctcccttggcagtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaaggaa

SEQ ID NO: 15041 - DNA, 5476 bp, Homo sapiens
agatggcggcgcctgaggggtcttgtggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggtaagtagcgggtccagggaggggttcggcggtggaggtcggtcggttggcaacagtggggtctgtcggccgactcaggggtctgtggtgagccataaccggagtctgtggactgaacggcgggagtctatgggcagaatgatgaaccatctgggagttctatggtgagccacggtggggggctccttaatagaagtttagtggggactccgtgtggcagttccgtgggaaaccatgatcgggggttcttagggcagagggataagcgggttgtaaggagtcacattgagtggtctgtagtgagccgtgacgaggagtccgtgtccgggtatccgtggacagccgcgactgggggtgggtgcgggtgccaggtgggtctatgagataaacagggaggggtgcgtggagaaccgcgatgggaagtccgcagtgagttacgcggggtctgtgaggcgccacgatggagggtcgccatgacccattagcgagtgtggacgcagggagcgggtgtcggtgggtgcgtgatgggaagtatggagcagagtaataggatgtcagaggaagggatgggggtcagtggggactgtgatggagaggttttttgggggccccgatgtgaaatctgcaggcagagtggggatccctgctgaccacggtggagttgtaatggggggatgagccgccacggtgggggctgcttaaggatccgtaatgggggtgtcctgcaggagggagatggttcagacccagagcctccagatgccggggaggacagcaagtccgagaatggggagaatgcgcccatctactgcatctgccgcaaaccggacatcaactgcttcatgatgtgagcgcgggagagatgggcggggctgacactggcagggtggggtgaggccgatgggccgcgcccctcacatctccatcgcctgccccatcctctgcagcgggtgtgacaactgcaatgagtggttccatggggactgcatccggatcactgagaagatggccaaggccatccgggagtggtactgtcgggagtgcagaggtgagggccatggatggacagggaaggcaggtggggcttcaagggaggaggaggagccacaagggggggttatggggattagtgatacacgtctgtggtgagctggaatggggctccattgtgagtaatagaagatcccacgggaagaggcagctctgccctggacaggggtgcagagtaggtgggtgggtcagtaagggagcgaagaggaagaaagaggttttgggaccattcaagccatccagtgctcactcactttggccctactctctgccccacagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccaggtgagtggctgcataaagtgaatggatgtgtaaagtggttccgtttcagccctgcctgggtccatgatttctgttctgggccccctcctgcagcatcaccagcagcagcagcagcagatcaaacggtcagcccgcatgtgtggtgagtgtgaggcatgtcggcgcactgaggactgtggtcactgtgatttctgtcgggacatgaagaagttcgggggccccaacaagatccggcagaagtgccggctgcgccagtgccagctgcgggcccgggtgagcatggacagagctgggtagggtcaggtgtgggagagctggtgggtccatgcatggttagttaagtctaggcatggataaaccaggtgggattgggcctgactgtatcctgacaggtgggaaggggcctgtcatgtccagatgaatggggcatgacctggtatgctgggctggcagaacacccccaccaaccctgggtagacagagtggggccaggtgttttcaggtggtcatgcatgttggtacagatcaggcagggctgagcattcctggcaatgaggggtagcggggaggtgtgtctggggaggtaaggccaggccaggtgggtagggctagggcaaggccgccctccatccacctggggctgacctgggccttcctcctgccggcacaggaatcgtacaagtacttcccttcctcggtgagtccagccccccagggtggggtggggcatgcgggcagggcggtcagggccagtcctgagattctgccctgcagctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctggtgagcagacaggagcatccactggtggaagggtggaggttacagaagcagagagtatccctaatgaggagacagagggtatggaaggctgatatgggacatgagtaggtggtggggttgtcacgagcggggcaggtgggtcagtgcatgccctgcttgcagccctggatgagcgacacagaagagtccccattcctggaccccgcgctgcggaagagggcagtgaaagtgaagcatgtgaagcgtcgggagaagaagtctgagaagaaggtgatggagagggtaaagtggatgtggaaaggcagagggtggggttgagggagaggcagaggtcagaggctgaatggggcaagagccagaaagggctagaatggagcaagggtctggggtctggggctgactttgactccaccctgacctgacttgtcttgctcaacagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaagtgagtcattcctgagaggttcaagggagtcaggaagtgcatggtagggcctgaccacagccttctgtatgtctaccagtcaatcagctatccaccagtcaccaaacagccactacccactcacccatccacctacccacccacctgcccgtgtgtccatccagccaccattccgccagtcacctatttacttctccttttgccatttgcgtctattttgccattctcacttactgatcacctcactcattctgttgcttgctaccttccctgcagccgcatctacgagatcctcccccagcgcatccagcagtggcagcagagcccttgcattgctgaagagcacggcaagaagctgctcgaacgcattcgccgagagcagcagagtgcccgcactcgccttcaggaaatggaacgccgattccatgagcttgaggccatcattctacgtgccaagcagcaggctgtgcgcgaggatgaggaggtgagcaagcaggggcgcagcagagcagggcctgtactttgtccttcccagccttattgttccttccattccatgcagagcaacgagggtgacagtgatgacacagacctgcagatcttctgtgtttcctgtgggcaccccatcaacccacgtgttgccttgcgccacatggagcgctgctacgccaaggttggggtgtcagactgagggggcggaccatgtgggaacatcagtgggccagtgggggacagatttgttgtctgggtggtgtcttgggagggcatgcagcgcacatccacagttccctccatttgtgctcatccctccagtatgagagccagacgtcctttgggtccatgtaccccacacgcattgaagggtaagtgagggtgccacgcagtgagaggtggggggttaaggcgggggtcagaagtgggatgtgtgtggagctggggcaggatacgggcaaccagccaggacagatggacctcccttccctccctctactgccctctctactccaaatccccagggccacacgactcttctgtgatgtgtataatcctcagagcaaaacatactgtaagcggctccaggtgctgtgcccgagcactcacgggaccccaaagtaaggttttccctcagctcctcccattttgcccctcctccctgcctcgctgtcccacattcatcccttccttcctcacctcacttttccttcactttttcctctcagcttccctgctgcttcaccctccattcctccttttccatgcctcctcaccgttccctgaaccctccattcttttccttctccctccttgagcccccattcctattctcccttatcaccgctattcatccccccaacctggcctccttgcaggtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtggtaggtttctgtgcggttttggtgctgcatgtggtaggtttccatgtcggacgtggccggggcaggcggggctgcaggtgttcctgcttaggactcctgccgctcccttggcagtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaaggaa

SEQ ID NO: 15042 - DNA, 128 bp, Homo sapiens
cccagctactcggaaggctgaggcaggataatcgcttgaacccgggaggcggaggttgcagtgagctgagatcgcgccattgcactccagcctgggcaacaagagtgaaactccgtctcaaaaaataa

SEQ ID NO: 15043 - DNA, 1767 bp, Homo sapiens
cacggacacaggaagtggccgcacaatgcaacatctacttaccctctgagggatggtttgagtccctgtcatcgaagggtagactggcagaggaactagaagatgcagacaaggccctcttggtacctcccgcagctctctgcagtggggaagacatgcttggtgaggaggagctatggggccaggaagacgaggaccgcaggtaggtttggcaatccagctggggaagaaagagaagaaagggctcctaccacagcacttctccatccccagccgtgagcagtccctttctttgcaagggaatggttctagaactctggggtcgggtgagggggaccaaaaactaagacaaaggctgggcaccgtggctcatgcctataatcccagcactttgggaggccagggcaggaggatggcttgagcccaggagttcaagaccagcctgggctatagagcaagaccccatttctacaaaaacaataataataattagccaggtatggtagcgcatgcctgtattcagctattcaggaggctgaggtgggaggactgcttgagtccaggagttcaaggctgcagtgagctatgatcgcaccactgtactccagcctgggtgacaaggtgagactctgtctcaaaaaataaaaaaaatgaaagaaaagaagacattatgggatgcaagtctgcaaagccttaactacaaactaaagaaaccaaaaggaaaaggaagactttaaaatacaggagtagaaccatctcattttccccatagtccaataggtccctgcaattgatccccaaatgcttaaaacaaggccgggcgcggtggctcacgcctgtaatcccagcactttgggaggcccagggaggtgaatcacttgaggtcaggagtttgagatcagcctggccaacatggtgaaaccccgtctctactaaaagtacaaaaattagccaggtgtggtgtgagtgcctataatcccagctactcgggaggctgaggcaggagaatcgcttgaacttgggaggcggaggttgcagtgagcagagatcatgccactgcactccagcctgggcgacgagtgatattgtcactgtctcccccttgctaacctcctaggtgcttaggataaaacgtcaaatatttaacatggcttcacagacatcttgtatcatttggcccctggctaccttacctcacccaatttcctcctttgctctgtactctagctacactgtccgaggagttcctaaaacatcacgctgggtccgaccacaggatcttcacatgtgctgctccctctatctgcatcgctctttcctcttctcttgtttgcttaactcctatttaccctcgggcttaatcagcactttctcacctctcctagtctgttgctcttatttaagatcaaacagcagagaaatgtgaagtccactgacttccgggtggaacagggttcagtatgccaattaaattattgggtgctggctgggcacggtggctcacacctgtaatcccagcactttggaagggcaaggcgggtagatcacttgaggtcaggagtttgagaggacaacatgatgaaactccatctctactgaaacacaaaaattagctgggcttggtcgtgggcacctgtaatcccagctactcaggaggctgaggcaggagaatcacttggacgcaggagggggagggtgcagtgagccgagatcgcaccactgtactctagcctgagcgacagggtgactccatctcaaaaaaaaaaa

SEQ ID NO: 15044 - DNA, 481 bp, Homo sapiens
cagcactttgggaggccgaggtgggcagatcacctgaggtcaggagttcgagaccagcctggccaacatggtgaaaccccatctctactaaaaatacaaaaattagccaggcatggtggcgggcgcctgtaatcccagctactcgggaggctgaggcaggagaatcgcttgaaccggggaggtggaggttgcagtgagccgagatcacgccattgtacaccagcctgggcaacaagagtgaaactccatttccaaaaaaatagtatcagccgggcatggtggctcttgcctgtaatcccagcactttgggaggccatggtgggcagatcgcttgagcccgggaggttgaggctgcagtgagctataatcgcaccattgcactccagcctgggtgacagagagagaccctgtctcaaaaaagaaaagaaaatgtctactaagacctccactccctataatggcacattaagtatctccaacc

SEQ ID NO: 15045 - DNA, 6031 bp, Homo sapiens
gatcacgctgaccaccattggctacggggacaagtacccccagacctggaacggcaggctccttgcggcaaccttcaccctcatcggtgtctccttcttcgcgctgcctgcagtaagtccagctgcccctgcctgccttggagggggacgaggtcttgtaggctcccgaggtgaccacaggcccctgggcacagttccctaggtgggacctggggcaggagcagctctcagcaggtccacagcccccaggagctggaggtggcagctcagggtcagaggccttgttccccaaggactggagtgggggttccccagccccgacaggagcatgcccaaggctgcggctgtagcttcagggggctctgttagtcactggtggcccctcttagtctgagtggggctgagcaggaggtccttgtgaccaggagcagggcggctggtgacacaggtccctcatgggtctctaggcagtgaggcccacccagctcagagggaggtggaggggccctgtcaacccttgttgccccagggcagggcagggcagggcagctggtgcacggcaagaggctggccccggtgtccccttcactgtgtgcccttcaagatgggcctgcagactcttctgtgtggaagggaaagaggccactctgagttcagtgtgggtcctgccatgtctcctgcaagccagagggttccttcctcttgatgctgacaaattgtggggatatgggttcctggattagtctgaccttgatgaaggtgggggaggcatggatcggtggagacgggtctgaccctgatgaactggggggtgtgtgagtccctggggcgtggtctgaccctgatgaattggggggtgtgtgagtctctggagtgtggtctgaccctgatgaattggggggggtgtggggccccagagcatggtctgaccctgatgaattggggtgtggggggtccctggggtgtgacctgaccctgatgaattgcagggcatcttggggtctgggtttgccctgaaggttcaggagcagcacaggcagaagcactttgagaagaggcggaacccggcagcaggcctgatccaggtgagtccaggtgtcccccggggaccagcacagcccttgtcctggtcccaccttgttgaggagtggaggccgctggggctttggcattgccctgtctgtggatgggccacagcgctcaccctctgcaggaatctgtggaaggagcgaggatgtgaagtgtgtgtgttgagaaatggctccaacccctgaggctgcacaggggtggctcgtgtgaggacgctggggtggcccttgccttgtgtgggtgctggggcccggccatcaggtcctctctaccgcaccctgggaggtgagcacacccgttctgcagctgcagggccaaggctcctagagcccacacactgcagtgagtcagtgcctgacctcgtctgacccctgatgctggctgtgggcccccatgatgcccgcccggaccccacccagtgccgtcccaccatttgggggtgggtagcgtgcagtgaccactgtggcatccacaagtaattcctgagccaccttgaaaatacggacagacaatggccgggcacagtggctcacgcctgcaatcccagcactttgggaggccgaggtgggaggatcacgaggtcaggaaatcaagaccagcctggccaacatggtgaaaccctgtctctcctaaaaatacaaaaattagctgggcgtggtggcgtgcgtctgtaatcccagctactcgggaggctgaagcaggagaatcgcttgaaccagggaggcggaggttgcagtgagccgagatcacgccacagcactccagcctgggtgacagagcgagactccgtctcaaaaaaaaagagaaaatatggacagacagcaggacccccttgggaccagccattcttgcagctcctccccaaagtcttccatccactggacccgcagagctgaccaggatccctgccagcggaatgtggctataggctctctcctgtcttagacagcaaatcttgagatggagataatcctgggttaccccaggtgggccgtaaatgcaatcacatgcatccttataagaaggagatttgacacagaggaggggaaagcagtgtgaccacaaaggcggagactggagacgtggccacaagccgcggagtgtcagtggccactgcaggggatgtgcctcttgtggtcttggctctgggtccagcctaccttaaggtgtgtatttatcttccactataaaaactacaaacagctatttatttccaggcaagagttttaagaagaaccaaaatgcccccaaatctcactccactattgacggtttaaaaagtgaccacgtacgtgtggtgaaaaggttacaatagtgccagaaaaagcagcgtctgagcacccagggtcccatgcgccctgcttccctcgaaggtcactcttagcagctggtgcacatttccagagcacagctgggcctctccacaggcgcacctcagaggacctgcagccgtggttccagaccactacggtagagatacggcaataaagcgagtcacacaaatttcgtggtttcccagtgcatatggaagttatgtttacaggctgggcaccgtggctcccacctgtaatcccagcactttaggaggctgaggcaggcagatctcttgaggtcaggagttcgagaccagcttagccaacatggtgaaaccccatctctactaaaaatacaaaaaaattagctgggcgtggtggcacacgcctgtaatcccagctactcaggaggctgaggcaggagaatcacttgaacccgggagacggaggttgcagtgagccgagattgcgccactgcattccagcctgggaaacagcccgagactccgtctcaaaaaaaaaaaaaaaaaaagttatgtttataccatgccatagcttactaagtgtgcagtagcattatgtctaaaaaacagtaaaacactgcacgtactttcacttacaaatacttaattgctaaaaaaatactaacaatcacctgagccttctgcgagttgcaatctttgtgctggtagggggtctcacctcgatgctggtggccactgctgatgaggtggggctgctgaaggctggggctgtggcgattttttttttttttttgagacggagtctcgctctgttgcccaggctggagtgcagtggtgcgatctcagctcactgcaagctccacctccctggttcctgccattctcctgcctcagcctcccaggtagctgggactacaggcacccaccaccacgcctggctaattttttgtatttttagtagagacggggtttcaccgtgttagccaggatggtctcgatctcctgacttcgtgatcctcccgccttggcctcccaaagtgctgggattacaggcgtgagccactgcgcccggctgtggtgatttcttaaaataaggcaagaatgaggtttgccgcatcgattcactcttcctttcacgaaagatttctctgcagcatgcgattctgttggatagcgttttacccagtggacctcctttcagcatcgcagtcagtcctctcaaatgctgccactgctgtatcaactaagtttatataatgttctcattccttgtcatttcaacacagttcacaacatctttgcctggagtagattctgtcgaccaaaaaaaaaaaaaaagaaaccacacacatgtcaaatgtatttgggaattagaagaaaggattataaccagagatgaaccactgtggccagagggtgggggactctcgagagatgagccagtgtggcgagccacccatgtgccggagagggaggggcagggaagctctccctggctgagaagttcacataagctgcttggaaacagagttcactggctctgaggctgaaaaccagagttggcagccgttcactggttgagatgccgctgctgggccagtgttcttcctagagcatcttgtctgaattgctgcattcctgataaggaattccttgtggggttattttagaatgtctttgacactgtcctcatctcagccatgcaggcgtgagccctgccgccgtgtactctctggcctcggttggtttggacctgacagaagtgaccttaccctgctgtctgcagtgttcaccgtccatcccaagaaaccacttactttgctcatccataaatgctgctcctcacctgttagagttttatcctgagatggcagcagttcagtcccgtcttcaggctccacgttaggatggccaactttttttttttgttgttgttgagatagggacttgctctcttgcccaggctggagtgcagttgtgtgatcttggctcactgcagcctcgacctgccaggttcaagcgatcctcccaccttagcctcctgagtaactgggactacaggtgtgcaccaccatatctggctaattttttgttttaagtaaaggcagggttttgccatgtttcccaggctgggcttgaactcctgggctcaggcgatccacctgcttcagcctccaaggtgttgtgagcctctgcgccaggccagggcggctgacatgttagcaaatggcaaatcagcgtagtgaggatgtgtggacaccgccccccctgctggtaggaatgtagcgatgcagtcaccctggaaagcagttcggttgtttctcagaaagttcgtaaacgtggagttgtcacgtgacccggccattctacctctaggtatagacagacacaaaagaattgaaaacagaccttcaaccaaaaacgtgcacacaaatttcacagcagcaccactcataggaaccaaaaagtggaaacagctgaaatgtctattaatggatgaacggaatgtgatttatccatacgatcctcctatcaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcgggggtaggagggggtttatttgggggcgacgaagaggtgtggagttagataggggcagtggtcgcacagcactgtgtgtgcaggcgctactgaagtgcacgctttaacatggctaacatggtgaacttcaggatatgtctatttcagcaccgcaaaacaaaacaaaggcatagagaacggaaatccagccaggcgaggttcagtctgacgtacaggctcatgccccgagccgggctgagtccccgccctgggaggttggaggctgaggtccctggccctacccatactcccagcgcctcaggttgcccagggcccaaccaggaggtcaggaaggtaacccccaggacaggtgatacccgccaggggccaggtaagagtcatgaaaaggaaagaacacagcctccctgcgagctcgctcagggccccgagtcaagccccaaccgctcccctccttcaggccccaccgtctgacaagcgggcttgcctgtctgtcctacagagggtaaactgaggctgtggggctgatgcagcactggggcctggcctgctggcccagagtcctgagtgcctggcctacagcatgggggtcccctctgccccgttccctccacgcccggccctcctgggcgcgcccctcgccgcctgcccctcgccaactgccttgtctttccctccgcagtcggcctggagattctacgccaccaacctctcgcgcacagacctgcactccacgtggcagtactacgagcgaacggtcaccgtgcccatgtacaggtaccgccgccgggcacctgccaccaagcaactgtttcattttttattttccatttgttcttaaaccccactttttgttgttcattattttgattgatttttttctttaaaatgtatttttcacaaagga

SEQ ID NO: 15046 - DNA, 186 bp, Homo sapiens
aatacaaaaaattagccgggtgtggtggcgggcgcctgtagtcccagctactcgggaggctgaggcaggagaatggcgtgaacctgggaggcggagcttgcagtgagccgggatcacgccactgcactccagcctgggggacagagcgagactctgtctcaaaacaaacaaacaaacaaacaaaaa

SEQ ID NO: 15047 - DNA, 1015 bp, Homo sapiens
gtttaacataaatcaaatagttccaatgggttgcttcatatttgtgtgtactttaaagtcatgccagcttaaatgactgtgaggtacaatgtgttgactttgagttttgtaaattgataatttgttgctatgaaagttgtccatggtataactcatcactttttgaaggtacttagtatgtctgatactggcaagctgtcatgaaaaaattgatgcccagggaattccggggttttgctttcagatgtttgacatgtagatatttaattcttcttaagatttccctggacattgtcagtgtaaggtgtactgatctttaaacacaaactttagtttgggctcctgtttctcagcattctttgggataataatctgaatggtgtattctcaagtttttttttttttttttttttttaagtgtatgaatcaccttggggatcttgttaaaaggcaggctatgatccagtgggtctgggatgagtcttgggattctacattttcgcaagctcccagataatgccagtgctgctggtccacagacagtactttaagcagcaagacaacactttgatggacaaagtggtgctgtgcaacacccatcacatacaaattaccagttgctttcctcattgtgttttggtgcatctaaagctaagatgatctggtgtatattcttgactcttgggtatccctgtgagcattaatgaatagtttaacaaccgaccatttggtctagcatgtatggagactaccaagacaggcttattgtgttggaagaagtgatgcttatgtttttagactcttatggaatataccaattcctgtatgttagccaaggttcttgctgcaaacagaagtgaatacaacaaactgctaacttgaaaagatgctgatagaggggttagaaaggcatagtgctgaatcaaatgtatttattttaactagctctgttcatgatggctggttaatttgggcaaaaagatttattgatgaatcatggagaaaaagtgggaac

SEQ ID NO: 15048 - DNA, 462 bp, Homo sapiens
gcacaggtttgtcttattaatctacaagtctgggcaactcttattatttaatagaaagtcctagctaccgtcattcactttattttttctttctgctataattgcaatgtaaacaacttagcacaatttcttgaggagtgcatgtttctctttttgctcttgtttagaatcccttccctccttatccatgtggtgaagcctgagatgagctaaatatcttctcttttctgcagccattctccctctctgtctccccacttcttgctctgccttctgtctctctccctccctccctccctcttttgtttcttcccatgcccaacttcaaagatttactccctccaaggtcagtggtgccatgatgtggaacttatactactcgtatggttgtttttctccagaaagcctaggagctccttgaggacgagactattggcttaaagatatagtaggtactcaata

SEQ ID NO: 15049 - DNA, 537 bp, Homo sapiens
ccttggtaatataggaaaccttcttgccaatataggaatatgttgacatattagctatagcaaaaggcttatattagcaccgaatgaggctctgctgcatccattcacctagggaatatgcactgtggcgcttcccaaaggatcacttgcaggtacctcagtgtacctgatggcttgactgttgttgcagccattagtacatctcccttcttgccacctttctctccccaaatctcaacaaaaccagttgtttttaatcttaacactacccatcaccctcctacactcactgaaatgtcttcagcccctaacctctagaagagctgaggacatcatggaaggaaggtaagtctttctctgaaagagattgtagacctgggatataatggataaagtgatccccaagatgcacttttgatgttttaatttctcagattttttttgctagatacttactttgcattgctttgttgttgttttgtgaaagaacagacttctaattttaaaacacaaggtgaagaaatgttaaaaaaaaaa

SEQ ID NO: 15050 - DNA, 1617 bp, Homo sapiens
gcacattctctgcccttggcctgacgtattctcccttatcagcacataccacaagtctttcaagacctataaaatcagtaccattttctctgggaagtcatcctgattcccctctttctgcgtatggtgaagaatgctttatggaatactctgcattcctttctctcaagacttagatttaccattaccatatggaaatttctaggctgtttccaatgcctaggtggtgctcagaagtgttagtggtttagtagaatcctaattgtggagaaagacagccaaatttgggaggtttttagcatagagtaaccctggcattcagggatgtttgctgtgcaagatgggtgtggtaccagaggagctgttcctggaggaactgaatctcagtggcttgaagtggtcagttccggcattggtatgttccccttctgtattgcacagagctgggaaaccactgaagtcatgtgctctgcagaacttgttcaactggtttcctctccacagacccctaattcagatttccacccttattcttttctgcatatgctcttagtctgggcttgttttaaggtttaccacagtagagttctcagtatagttatttatttgtcttgctgagtgtagagtgggtagggccaagtatgtactccctttgaaaagtgttatcagtaagacaagatagacaggtattatgtaaatcatggagtgtcagactccattagcaggtttatttctgtggatctaaccatttcacccccacactcatgtgtacatacacatatacatagctatcattatttagagcctactactagttgctgggtgaggtgtcagagccccggcattggaaagtagtcaactcacaggttggtaggaagaatttactgacagcagtataggtttgaaaaaggaaagttttattagaaagaaggaactctgcagaagaatgcctcagcaagagagaactgagctcgcggtggatttttcccttagggtatttatggaacttaaagcaggagcttaagggtagtttggaccatattagccaataggtcatgataaatgattacatttttagacgtaatgtcagcaagggttgcacagggagtttcggcatggcattccagagatgtatagaaagtctagttgcttacaaattttaggttgaaaagagagctggaaccaggtgccgattttagataacagggaagttaattacttctaaattcctcagataagaagttttgcctctgaatggtctccttagtggactccaggtgatcactagtatttggtatgtatcatctcatttaatccttacaacaaccttatgaagtttggtgtgttgctaatcctgctttatatatgggaaatggaagctcagagaagttagcgggtaacatgtcattcttggtttttcttatgtccttccctcttatctcagggaggaagtggggtatattcctttctgtagctggctgccgcctctgctcttcagaaccttgctttcttttgttcttattcctgtatctttagcccctccttcacgtgttcttttcttgcagactataaaaatatgctttttccacaatcatttaaaaaaaataaaaagacact

SEQ ID NO: 15051 - DNA, 1616 bp, Homo sapiens
gcacattctctgcccttggcctgacgtattctcccttatcagcacataccacaagtctttcaagacctataaaatcagtaccattttctctgggaagtcatcctgattcccctctttctgcgtatggtgaagaatgctttatggaatactctgcattcctttctctcaagacttagatttaccattaccatatggaaatttctaggctgtttccaatgcctaggtggtgctcagaagtgttagtggtttagtagaatcctaattgtggagaaagacagccaaatttgggaggtttttagcatagagtaaccctggcattcagggatgtttgctgtgcaagatgggtgtggtaccagaggagctgttcctggaggaactgaatctcagtggcttgaagtggtcagttccggcattggtatgttccccttctgtattgcacagagctgggaaaccactgaagtcatgtgctctgcagaacttgttcaactggtttcctctccacagacccctaattcagatttccacccttattcttttctgcatatgctcttagtctgggcttgttttaaggtttaccacagtagagttctcagtatagttatttatttgtcttgctgagtgtagagtgggtagggccaagtatgtactccctttgaaaagtgttatcagtaagacaagatagacaggtattatgtaaatcatggagtgtcagactccattagcaggtttatttctgtggatctaaccatttcacccccacactcatgtgtacatacacatatacatagctatcattatttagagcctactactagttgctgggtgaggtgtcagagccccggcattggaaagtagtcaactcacaggttggtaggaagaatttactgacagcagtataggtttgaaaaaggaaagttttattagaaagaaggaactctgcagaagaatgcctcagcaagagagaactgagctcgcggtggatttttccttagggtatttatggaacttaaagcaggagcttaagggtagtttggaccatattagccaataggtcatgataaatgattacatttttagacgtaatgtcagcaagggttgcacagggagtttcggcatggcattccagagatgtatagaaagtctagttgcttacaaattttaggttgaaaagagagctggaaccaggtgccgattttagataacagggaagttaattacttctaaattcctcagataagaagttttgcctctgaatggtctccttagtggactccaggtgatcactagtatttggtatgtatcatctcatttaatccttacaacaaccttatgaagtttggtgtgttgctaatcctgctttatatatgggaaatggaagctcagagaagttagcgggtaacatgtcattcttggtttttcttatgtccttccctcttatctcagggaggaagtggggtatattcctttctgtagctggctgccgcctctgctcttcagaaccttgctttcttttgttcttattcctgtatctttagcccctccttcacgtgttcttttcttgcagactataaaaatatgctttttccacaatcatttaaaaaaaataaaaagacact

SEQ ID NO: 15052 - DNA, 1616 bp, Homo sapiens; identical to SEQ ID NO: 15051

SEQ ID NO: 15053 - DNA, 344 bp, Homo sapiens
agacagggtctcactctgttacccaggctggaatgcagtggtgtgatctgggctcactgcagccacaacacccccaggctcagatgatcctccttgtctcagcctcccaaagtgctgggattataggcgtgagccacctcacctggcagtactgtgttcttaatgtatatcatagttaacccccactcccttattttcttactaaataataggtgtgaaaattaaatttttgacatatatggctctagcagaggattgcttttacagagaaataggtgcctgtcttctactttgtagaggactcttacctgttgttttcttctcaagagctgctcacaggttag

SEQ ID NO: 15054 - DNA, 344 bp, Homo sapiens; identical to SEQ ID NO: 15053

SEQ ID NO: 15055 - DNA, 1108 bp, Homo sapiens
agttccaccaacagtgtaaaagtgttcctatttctccacatcctctccagcacctgttgtttcctgactttttaatgagcgacattctaactggtgtgagatggcatctcattgtggttttgatttgcatttctctgatgaccagtgatgatgagcattttttcatgtgtctgttggctgcataaatgtcttcttttgagaagtgtctgttcatatcctttgcccactttttgatagggttgtttgtttttttcttgtaaatttatttgagttctttgtaggttctggatattagccctttgtcagatgagcagattgcaaaaattttctcccattctgtaggttgcctgttcactgtgatggtagtttcttttgctgtgcagaagctctagtttaattagatcccatttctcaattttggcttttgttgccgttgcttttggtgttttagacatgaagtccttgcccatgcctatgtcctgaatggtatttcctagttcaaccattgtggaagacagtgtggcaattcctcaaggatctagaactagaaataccatttgacccagccatcccattactgggtatgtacccaaaggattataaatcatgctgctataaagacacatgcgcacgtatgtttactgcggcactattcatgatagcaaacacttggaaccaacccaaatgtccatcagtgatagactggattaagaaaatgtggcacatatacaccatggaatactatgaagccataaaaaaggatgagttcatgtcctttgtagggacatggatgaagctggaaactatcattctcagcaaactatcacaaggacagaaaaccaaacaccgcatgttctcactcataggtgggaattgaacaatgaaaacacatggacacagggtggggaacatcacacactggggcctgttgtggggtagggggaggggagaggggggagggacagcattaggagatatacctaatgctaaatgatgagttaatgggtgcagcacaccaacatggcacgtgtatacatatgtaacaaacctgcatgttgtgcacatgtaccctagaacttaaagtataataaaaaaaaaaaaaaagaaa

SEQ ID NO: 15056 - DNA, 19459 bp, Homo sapiens
  misc_feature (961)..(961): n equals a,t,g, or c
ggacagcgtggagaagggcgagctggccgaccgcgtggggaaggtgggtccccggaggcttggctggcggtggggctgggtcacagctttgaaatctgattcttcgtcttccccgtctccgtgtccaggtgtccgtgttcttcaggaccagcccaaagcacaagctcaaaatcatcaaggttcgctgggcaaggcaggcacaggtgcgctgctggggccgggccagagacactgtggctcgaggagctcatgcgtctgtcgggtgacagtgcagggcccgaccgtggcttccttctctaggtccaggcagctgccccgggagttaccttttcatagccagggggaggggaggaggttgagcaggggcgcgtgggcagctcccttggagaggacgaggctctgaagttgccagcaacacttgcgctgacagccccttggccagaacacagtcacgggcccaggtttagctgcaggggatgctgggaagtgtcatctgtagctgggcggacacgagccccaccaaacctggggataattttaaagaagatgggagaactgggggacctttgctacatacagtgaaaactgggagctgtaattggataacgtagagggaaaaactaaaagagaagctatcttttttttttctgggggtggggttgtaggtacggagtcttgctctgtcacctaggctgcagtgcagtggcacaatctcggcttacttcaacctctgcctcccagggtcaagcgattctcctgcctcagtctccccaagtagctgggattgcggtgtgcaccagcacacccggctaatgtttgtaattttagtagaggcagggtttcgccatgttggccaggctggtctcaaactcctgacctcaggtgatccgcctatcttcgcctcccaaagtgctgggtgctttttggctttattcctgttactcaactccgtgcctccgtntcctcatctgtaaaatggggaactattaatgccgtcagctgattcacagggttggtagaaaattaaacaaagccaggcccatgaatctcttggcacacagcaggagcccaataaagagctgatgtgatttttctgactctgaataccaaaaaaaggtagaaaatgtgcttggttttctcgcctgtgctctgaaagtttgctcttgagctcttttagtagacgggctttcttctttcatgttatttttagctctacagagtaaatccctatgtgagttactcctcaaagaaggtagtaatacttaccaggtaccccatggtttccagggccgcactgttgattactgtttattactgggactggataacctttatgagcctttactgaccgtgctgggcaccgtcacatccgtcatctcagtttgggcctcacaacagccctgggaagaagaaactgttgctcccactttgcagatagggaaactgaggtcaagagggtcaagggctcgcccaattcccacagctaatgtgggtgaagctgggattcgaattccgggtgccctccagacagaggtgtctgtggctggccacagggtgtgcatggccgggcactgggaggtggtcgtcaggctgcaggccttcattgcctgctctttccaaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgtaagctgcccttctggttgtttttcagttgcaaaaatgcctggggtcaccagcttctccctggaacctgctactgtggagatagagggggggggggtctcgcggagtccccagggagagctgaatctcggggctcgtcagtgtggcaggtgcccccaaccccaagcaccaacagcctctcatagcagggtcatggggtccatgatgcctggggctagtcacatgctgcccccaggggaatgttacggatatgaagcagagatgggatttgctgcctgtgggtgcatttcatgtggtactgggaatgcccgcctggctcaggctggtgggcagcagctgaatatgtaaggaaaacctgtggccaaatacgtgctcacacttgagtgtggggtgagaaaggattaaaatgaacatcttccgtttgaggcctgcgtgttgatacatatatctcaggcattgcaaagagacctgggcagaaacacccccatcgctgaccacggaggtgctctctaggttctggggcttgcacaaaactatttgttctgtttcacttttctgtatttttttcttaatacatttaccttcctaattttaattagttctgagactctcctcataagctaatcgcagtggttagttgggggtgagggaaaactttttaagcctgatacaaaaaatccaaataaacaaatattgaggctaggtggatcgtgcactttacaaaggtgtctccacagttgattcgccataggaagccttaacacacttagaaaaaaaaaaaaagtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactttttggttggtaaactattgattattgtcacaatttcagagcctgttattggtctattcagagattcaacttcttcctggtttagtcttgggagagtgtatgtgtccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatggtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaagcaaaaaagagcccgcatcgccaagtcaatcctaagccaaaagaacaaagccggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctagacattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatatgcagccataaaaaatgatgagttcatgtcctttgtagggacatggatgaaattggaaaccatcattctcagtaaactatcgcaagaacaaaaaaccaaacaccacatattctcactcataggtgggaattgaacaatgagatcacatggacacaggaaggggaatatcacactctggggactgtggtggggtcgggggagggatagcatcgggagatatacctaatgctagatgacacgttagtgggtgcagcgcaccagcatggcagatgtatacatatgtaactaacctgcacaatgtgcacatgtaccctaaaacttagagtataataaaaaaaaaaatttaaataaaaaaaaaagtcataatatcagctctataattcttttcagaatattttagtaaaatctggcggtgggggcaccacggtcggtaattgtttttctacattagtgaccccaggtcaaggtttaaaagggcttccgcgaagagccttctaaagacagaagcaggcgatgtccttcagcggccccatcccgccctccttaccgtcctccggacctcatttttaggccgaactggttttgctgcgtctctctctcctctttggtaaatcgcggagatgcacggcgcacttcgggagtctgggcagggatggggccccctggctcggccggagagtaattcatggtctgattggaggcatcaggtgtacccttggcacagaagggcgaacatggctcaaggatcagttcccagtggccgaggggcacctgttagaacaccaacgtctcctacaaatgtgtccccaagaatgccagcaaggggaaccagcaggggcccaagtataacatcaatctgggcgagtcaccactgccccttgcagcaaccgatgcactggtccagccctcccgcaggcccgctccgtgagtaaatggctctcttctcttgcaggaatgcagtggaggaaggcaagggtattttttacaacatcaaaaactttgtccgattccagctgagcacgtaagtagaggccagcattccgagtgtcattaagcaccacgcctggcgtgcggccgctgactggctgcgtgtgccccgcaggagcatctccgccctgagtctcatcactctgtccaccgtgttcaacctgcccagccccctcaacgccatgcagatcctatggatcaacatcatcatggatgggccaccggcgcagaggtgaggcagggccggctgggagccctgtgtctctttacccacctgcggggcttcctccaggggctgctggctgtgccccaaggctataaggatgaacaaatacagccactttccatcaggagttcccagaaaactgaagtgtgttgcactggagtgagactgggagtagaaggcagaggagaaagtacctgggccggcagagctgggtgaggatggaactttccgctccctctgcctggatgctctctctgggcaacctgcatggctcattctcatgcttcattccagtcaccagtcactgccttcaggaagtcttccctgattgcactcccactcaatcccctcaccctgctgtatttttccctagagaggaagatacacacagacacacttttccttatggatctgattgtgatctgtctcccctttagaacatcagtttcatggaggcggagtttgtgtttcatccctgatgtctagagataaagggcttgccactcagtaggtgctcaggagtccacctgctccgcgacttaatatccccttcaacaagctggccaagtggtgtgggggaaggaatgcgctttggagtcaggggacccatctggccacgtgtgcgtaaccgtatgagcacagagccagtgcttccgctggagctcagtgctgctgttatcaccagtgacagctgccaagggaaagagagtcctcatttgtgtccccaaagccaagtgtgagggttacctctcctgccagccctccctgggagcagaagtgggaccaggaagctggcctcagctgtgtctgagcggcagggcctcacccggccactcccaccataccgcctgctgcgggtctagcctcaaccctgctgtgtggagttggctggaggctggtctctctcagctgatgaggggctctgcggagggcggagcctggagcctgtttctccaggcgcaacgttggggggggtcccctcggggtgatggagatcatctgggtgtatggaactgtgtgtggttggccttactgggtggtcttccttcactgtctgcgggacagatggaggggcacagctgcccatggacccaggctctggggcttctggaaggtgccgaggagggcaggtgcgatgcctgggggcgttcagcaaatgcctggccctgccccctgtgccaacttggcctgggaggctcaggcacagctgtttcaagggtcctttatttcattcctggttcatttcaaagtgtctgtgtcttgttcggagcagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggaggtgagcgagggtcaccccggcctgttctccaagccctggtgcagtgcagacgctggggactgcagtccctgccctcctgccacagctcacatctgggagaggcaaacatgtacacacaccggacaatgtgatgccatcagaggcgtggggtgcatgaggcaaagggactgggtgacccctgaaagaagggaggtcgccaggtgtgtgcctgggaactacagaggccagcggggtggagatgactttgccgagacgggagttgaaatgtacatgaggacaggctgccccctgttcccttgtcaccaggaaacaatttgaaatctgctaaatatcctcctgtgttacactctagaggtgattgtttgctttggatctaggcctgggtcaccttttcatggcctgcaggttcagggagctctgtgccaggacgggccatgatctaggtgggaaatgaggcaggtgacccatgtgaccacaccacagattgcccatgtgcaggaagcgggaggggacctggccgggtaccctgcctccattttccctccagctctccctctactactgacggccatccttcagccttccttgtaggaaatgaccttcactctgggtttaactggagtggcatcacctcccagggagacagttacttcctggaggaagtggtgtttcctccacccataggtgccctgcccccatcctcatggtggcagcaaatcagcatgtgctggggagaccctggggtagcagccactgacctcacacctggaggaagctgtgtgaccgattcatgagcttgtaagtggctcccagccgtgccccaggagcagtgaggcaggcctgtgccctttggttcaggatggaggttgtctcttcccgcctaacctctcacctttgtgctcaccttccagatgcctgaagacagagcaagcactccccgcaccacgacgatgacgttcacttgttttgtgtttttcgatctcttcaacgccttgacctgccgctctcaggtgagacccgggctgaccctcctcgctgcagagctgctgtgtgttctcgacagcagcgccccgaccctgcccgcagcattgagcggctctggctcagcgtgggcagtcagagctcccctgcctgtacctggggtgtggacagcacacaatcccccgtgtgaccttctccctgcagaccaagctgatatttgagatcggctttctcaggaaccacatgttcctctactccgtcctggggtccatcctggggcagctggcggtcatttacatccccccgctgcagagggtcttccagacggagaacctgggagcgcttggtgagtggtggggacgggaacgacaggtgacctcgaccagggccatggggggcggcagctgccaggtggggagctgcagcccaggaggggtcagtgcgggaaagcagagctcaccaggggccggctctgtcttcagggcccttctgtcctcacaggaagggactctaacgtgggtgatgtgacggatgcacagaaacccctaggaagaggcctgtcactcaagagtagtagggtctggggcccaaggggcaccggcatcccaggcgtccggctggaggctcagagcacgtgcagggaggaaggagggagcaaggcctggactcagcctgggaggtaccccagctggggagcctggacttgaccctggggccagtaatgtgacttagagatctggtcacctgaaggcagggagctgggctgtcttccagttttggctgaaagggacatgattcagtcaccgtggttttccaagggcacacaccctggtgtggagcccaggggactccccgacattgtcagccaagcgagtgtggcacctttctctgaagctgcggttatggcaggcatggggcaaggggagggagccagggacaagtcatcgaccccacccttttccccagggtgctgagagccacccccaacccggaatagaggacgagggaggccagtgaggcagcccccacggcccaccgcctccccgccgcagggcccagagtgggtcatggctcagatctggagggtcatgggattatgcatcagacctgaggctgcagtgacaacggtcctatgacctccaggcaagactgggatggtcaactctgccttgtcctccaaaaagcagtgtcagtgtgggtcaccagtgaatgccctgtaggaacagacaagaggaccccccaaaacactctgctcactggctgtttcccaccgccgggaaggaagtcggcttcccacgcctgaaggggttgtgcttgggcagcccgtacatccgacctcatcaacagggagccagggatgttcctcaaaacagcatgtgacaggagcagagggagacgctgggaattcatcccagggaacatgtcgggtgcactggacagggagccagactgtcactcaggacattgcaagcagcagggcactgggacagctgctgtcgggaaagaaactcattccccttccagcccgagtccataacatgctcccagctgcctgccagacccaccctgtgctctggagctgcctggtgtttgcctggaaccacaggcaggcccttctggaactgcagcattttggatcctgggttaggaagatctccctgccttcaggggaatgaaaagggctggtcctccgcacctctcactttatcaggaggactggcagggaaggcgcttcctgccggcacaacagagctgcagcccgtcctgaatcttttctgttttctcccttggcagatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataattattttgatgtgtttacctagggtttttcatacaaggggccaggttggaaaccaacagccatgtgttaatggccacgtggggtgagcagcaatccatcatgaatggcctacaggaaggcctcggcttttggacataaagagtagggctgggcatggtggctcacgcctgtaatcccagcactttgcaaggccaaggcaggcagatcacttgaggccagcctggccaacacagcaaaaccctgtctgtctctactaaaagtttaaaaaaaaaaaaaaaaaaacagttgccaggcgtgatgatgcacacctgttaatcccagctactcgggaggctgaggcaggagaatggcttgagtccaggaggtggagattgtaccactgcactgcagcatgggcaacaaagcaagagtctctctcagaaagtggcccttctctccggaaccaggaactgtagtatctcctgctgcctgcagacaagcttgatttcccactgccccaaagacttccaaaaacccatctgctcttccacgtgacagatggcagaggagagaggtctccatgctgttcttctgcctgaagccacgccagaaccaccaaagggaaccagaaggggaactccgtccccatctctcaggaaataaggccagagctagaaccccccagttactagtcaggcctcactagagaaacagaaccaacaggatggagggagatgcagagatttgttttaaggaactggctcataggatgttgggggctggcaagtctaacatcttgagggcaggccagcatcctggagacccagggaagagctggggatgcaggctggaggcagaatttcctcctcctcaagggagttcagccttttcctcttatagtcctcatctgatcggatgaggcccactgacgttatgaaggataaactgttctacttcaagtctacgggcttacatgttagttacacagcgccatctagaccagtgtttgcttgacgaaaatcaacttggcctggccaagttgtcagataaaagtacccgttgcacccagccacggtagctatgaaaagggctaccaggggtggtaacagctgggtcagacgaagataaggaaggtcagagtggacccctgccagggttccaggcagagtccaaagtcctccatagtaggattcacagcctgggaagaagcccctctctggctacaacctgtgacaccagggccacaggaggagatgcagcgatgggccattcctagtgagacacagacacagggctggctggagaagaaaccttttgagctgtggggctgtcttcctagaagctgccaacccctggaaccactaagaggtcaaggctgaagtgtgccacttccacagtctgctaaggagtgcctccccctgagtcagggacaattcttgctctacttttcaggatccttgggcacactgctggcccgagacatttacttcccatttaaaattaagtaatcaaaataccagggtcgattgatatttgcaataacaacaaaaattactctgaactcttgcttatgtaaactttagggataaaactgtagtaagacacaaaatgctaacaataaaatataaattagactacattaaaactaagaccttcttttcattaaggacacagtagacttgaacaccaccattaagcaacttagcttgatttacacttgtagaacaccccattcacgagtagcatagaaacagtcaccaaaataaagagcagaaatcaaacgaaaaagcaaaaatagaggaaaatcaatcaaaacctagtttttcgaagagatcaataaaactatcagtcttgcaataagcttatcaaagaaaaaagggaagagaaatgaccaatgtcaggaatgaaaaagtgtatcaccacaaacccttcaagatattccaacaataataataaataatactatgtacatctttatgtacctaaattcaatcaattggatgaaataaaccaattgcttgaaaaccaaaaactaccaaaactcactgaagattaaatagataagctgaagttgaaacccttccaaaaaaggcagtttctgaagccagatgatttcactggtgaattttactaaacttgtaaagaaatggcaattcgatacactgaattccaaaaataaaaggggaccgagcacttctcattttataaggtcaacaatcactctgataccaaaactagagaaaaatactagagaccaacatcccttatgaatatatgcacgaaaatcctcaacaaaatatgaggaaatcagatctagccaggtaggaagaatataagacaccaggacgaagtggggttaattgaggaatggaattcaagcattccaaagttcaacattcaaaaccaatataactgaaaagttcaacattcaaaaaccaatataactcactatattaatagtctgaagaaggaaaaacacatggttatatcaattaatgcagaaaaggcatttgataaaattcaatctccatttgtaataaaaactctcaaactaggaattgaaggaaacttcttcaacctgataaagaacatctacaaaaaacctatagctaacatcatacttaatgatgaaaaactgaattctttccccacaggataaggtccaagggtgaccagcctcaccactcctattcagcacagtattagaagtcctagccagtgtaatatggcaagaaaagttaaaaggcattagcaaagagcctggaaaggagaaaatcacagataacataattgtccacacagaaaatcccaacaaatctttttaaaaaagaaaaaccctcctagaatcaacgagtttagtaaagccacaagatacaaggttaacacacaaaaagcagtcgtatttctatatattagcaatgaacaactggaaactgaaatttaaaattgaatactatttgtctgtctcaaaaaaaagtatcaattctcccgagattgttgtattaggtttaacacaattaccatcaaaatcccaggatttttttgtttttgtttttttttaagacacagataaacttgttctaacaagcttggtatgatattgttatcagcagacctatttcaatttcactggtttttacatagtatctgatgttaggcaaacctgagtttaagggcacagtgctccaggtggctggccaagtctgcccaggccttctgatactgactgcaggtccaagagtttcccacaaccaccttcaggttggatgattcgttgatgaggcacacagagctcactgacacctctcatgctcacagccatgtctattaccaggaaaagatacagattagaacagccccagggctgcaactgcagagactggtcaccctctccctctgagctcaacagtttctgagtcctgagtctttctagccaatcactgggtctgagagtggtttcctgccccccacaacacaagttctatgaaattgtatgacacacatcaattcaggtaaccactgctacaatgaggaggcaaaacttccatcgcccctgaaaaactcctccttactttttatagtaacaccctcctaatcccagcaacctctaatcccttcttcatcaccataatgttgttccttcaatactgttacataaatggaatcatggtatagaaccttttaagactggccagctgccccaggatggaccccaggtgtgatggcaagcacctgtaatcccagctactcgggaggctgaggcaggctaatgtcttgaacctaggaggcagaggttgcagtcagctgagatcacaccactgcactccagcctgggtgacagagtgagactccatctcaaaaagtaaatatatatatatatatatatatatatatatatatatatatatatatatgcatacacacacacatatctcatttatatatatacacacacataaaaatatatatatatacacacacacacatatatatatatataaaacccttttgaatagataaaagatttaagaggtaaaaacagaaaccacagtagaagaaaatgatttttaatactcagagtagagacagactgcctaaacaaacggcaaatccaaagacccttaagcagaaatgctgggaaatatgacagaaactgtaaaatttatgggcagaaaaacgccacaaacgaagtcaaataaactgtagaaaacattgaccatacatgggaaatgctacttcattcataaaaagcactgttggccgggtgtggtggcttgcacctgtaatcccagcactttcggaggctgaggcaggaggatcccttgagttcaggagttcaagaccagcttgggcaacatattgagacctcatttctattttattttttaaaagcactgttacaaatcgataagaaaaagaccgacaccctagaaaaccaagaaaaagatatgatacagaaagcttttgaaaaatgaggctgttcactgtcacttggtagaaaaatttaaacagtacagttttgagcaagacaccatatgggagcccagcccacaagagactgcacaccagcctggggctcagcagcaccagggcagaggcacagcaaagtgcgggctgccactgccaaggtgcaagtggggtgcgtgttcccactcactggcatgggctgctgccactgaaagcagcctcaccctccccagtggcaaggtcacagcacaactgctgttacctcccacccaagcattccaccggaggcctggggactgccccctccccagctaccacagaaaatgcctgcgtatgccatggagggacctcagacaagcccgcccagcctggctttgccgcacatgctgatatggcttggctgtgaccccacccaaatctcatcttgtacttcccataatctccacgtgtcatgggagggagccgggtgggggaggtaattgaatcatgggggtagttacctccatgctgttttcatgatagtgagttctgacacgatctgatggttttataaggggctttgctcctgctttgctctgcacttctccttcctaccatcatgtgaagaaggacatgtttgcttccccttccgccatgattgtaagtttcctgaggcctccctagccatgctgaactgtgagccaattaaacgtctttcctttagaaattatccaggctcagatatgtctttattagcagcatatgagaacggactaatacacacaccctatgctggaacacacagtctagatgactggggacggcccagccgaggccaccactattggtacctgagcactcctctcagactgctgagcgtgggttcacccaccctgccactacctgcactagttggcatctacatgcacgtgccacctgtgggcctggagactggcccacccagctcatcacagccaccaccactaccaggtacactactagggacccagagggttaccctgccattgccactgccactaccatctcctatgccacactggctgcccaggggcccaagagcccagccacctggcccactgctgccatttagcatccaagcaagctatcctcaacaaaacactagcaaactgaatccaacagcacatcaaaaaaaaaaaagaaaaaaagaaaaaaagaaaacaggccgggtgtggtagctcacgcctgtaatcccagcactttgggaggtcaaggcgggtggatcacttgaagcctggagttcgagaccagcctggccaacatggtgaaaccctgtctctagtaaaaatacaaatattagccaggtgtgggggtgggtgcctgtaatccccactacttgggaggctgaggcaggagaattgcttgaacatagcaggcagaggttgcagtgagtcgacattctgccactgcactccagcctgagcgacaaagcaatattccatctcaaaaagcaaaacaaaacaaaaataatacaccacaataaagtgagatttatcgcacttatgcaaggatggttcaacatacagaaatcaataaatgtgatacatcacattaatagaatgaaggacaaaaaccatatgatcagatataagcaattagtaaactgatgcagaaaaagcatttgataaaacacgacattccttcctgaaaaaaaactgtcaacaaaccagacagaagggacatacctcaacataatcaagaccatatatgacaaacccacagctgacatcatcctgaatggggaaaagctgaaagcctttcctctaagaactggaacaagacaaggatgcccacttttaccactcctatgcaacataatattggaagtcctggccagagcaatcaggcaagagaaagaaataaaaagcatcccaactggcaaagaggaactcaaattgtccctttttgctgatgatatgatcctgtatctagaaagactccatcaaaaaactattagatctcataaattcagtaaagttacaggatacaaaatcaacatacagaaatcagtagtgtttctacatacagataatggaatatctgagaaataattcaagacaataaccccattgacaattactacaaaaaaaaaaaaaaacctaggaataaatttaaccaagaagtaaaagatctatacaaggaaaactacaaagcactaatgaaagacattgaagaggacacaaacaaatggaaaacatcccatgctcatggatcagaactaataccattaaaatgaccatactgcccaaagccatctagagattcaatgccatccctatcaaaatatgtcatttttcacaaaattaaaaacaaatcctaaagttcatatggaaccaaaagagagcccaagtagcctaagcaatcctgagcaaaaagaacaaggttgcaggcagcataccacctcacttcaaaatctattacagggctatagtaaccaaaatagcatggtattgctttaaaaaaaatttaaaaagagacacatggaccaatggaacagaatagagaaaccagaaataagtctacatatctatagccaacttatgttcaacaaagttgccaaaaacatacactggggtaaggacagtgtcttcaataaatggtgctgggataattggatatccatatgcagaagaatgaaaccctacctctcaccatctacaaaaaccagatgaagacgaattaaagatttaaatgtaagacccaaaactataaaactactagaagaaaacagggaaaacaattcacaaacccaacaatttaaaaataaacaatcccattaaaaagtagacaaaggacatgaatagacatttctcaaaagaagacatataatggccaacagctatatgaaaaaaaaaagagctcaacatcactaactatcatccaatccagcaatcccactactgagtatttattcaaaggaaaagaatcagtgtgtccaagagatatctgcatgccgacatttactgcagcactattcgcaatagcaaagatgtagacacgacctaaacatccaccaatggatgaacggataaagaaaacgcggtatataccctctcatgccagtcagcatggcaattattaaaatgtcaagaaacaatagatgctgatgagatcgtagaaaaacaggaacgcggctgggcgcagtggctcacgcctgtaatcccagcattttgggaggctgaggtggacggatcacaaggtcaggagatcgagaccatcctggctaacacggtgaaactctgtccctactaaaaatacaaaaaaattagccgggcggggtggcgggcgccctgtagtcccagctactcgggaggctgaggcaggagaatggcgtgaaccggggaggtggagcttgcagtgagcggaggtcacgccactgcactccaggcctggggcaacagagtgaggactccgtctcaagaaaaaaaaaaaaaaaaaagaaaaaacaggaacgctcttccactgttggtggtaatgtaaattagttcaaccattgtggaagacagtgtggcgattcctcaaagatctagaatcagaaataccactggacgcagcaatcccattactaggtacatacccaaaggaatataaatcgtatgttacaaagatacatgcacacatatgttcacggcagcgctattcacaataacaaagacatggtatcaacccaaatgcccattagtgatagactggattttaaaaatgtggcacatatataccatggaatactaagtagccatcaaaaagaatgagatcatgtcctttgcaggaacatggatggagctgggagccattaccctcagcaaactggcacaggaagagaaaaccaaacactgcatgttctcacttataagtggaagctgaacagtaagaacacatggatgcagggaggggaaaaacacagactggggcctgttggtggtagggctgcgggagggagaggattaggaaaaatagctaacgcatgctgggcttaatacctaggtgatgggttgataggttcagcaaaccaccatggcacacatttacctatgtaacaaatctgcacatcc

SEQ ID NO: 15057 - DNA, 6989 bp, Homo sapiens
  misc_feature (4281)..(4281): n equals a,t,g, or c
gcggccgctgactggctgcgtgtgccccgcaggagcatctccgccctgagtctcatcactctgtccaccgtgttcaacctgcccagccccctcaacgccatgcagatcctatggatcaacatcatcatggatgggccaccggcgcagaggtgaggcagggccggctgggagccctgtgtctctttacccacctgcggggcttcctccaggggctgctggctgtgccccaaggctatagggatgaacaaatacagccactttccatcaggagttcccagaaaactgaagtgtgttgcactgcagtgagactgggagtagaaggcagaggagaaagtacctgggccggcagagctgggtgaggatggaactttctgctccctctgcctggatgctctctctgggcaacctgcatggctcattctcatgcttcattccagtcaccagtcactgccttcaggaagtcttccctgattgcactcccactcaatcccctcaccctgctgtatttttccctagagaggaagatacacacagacacacttttccttatggatctgattgtgatctgtctcccctttagaacatcagtttcatggaggcggagtttgtgtttcatccctgatgtctagagataaagggcttgccactcagtaggtgctcaggagtccacccgctccgccacttaatatccccttcaacaagctggccaagtggtgtgggggaaggaatgcgctttggagtcaggggacccatctggccacgtgtgcgtaaccgtatgagcacagagccagtgcttccgctggagctcagtgctgctgttatcaccagtgatagctgccaagggaaagagagtcctcatttgtgtccccaaagccaagtgtgagggttacctctcctgccagccctccctgggagcagaagtgggaccaggaagctggcctcagctgtgtctgagcggcagggcctcacccggccactcccaccataccgcctgctgcgggtctagcctcaaccctgctgtgtggagttggctggaggctggtctctctcagctgatgaggggctctgcggagggcggagcctggagcctgtttctccaggcgcaacgttggggggggtcccctcggggtgatggagatcatctgggtgtatggaactgtgtgtggttggccttacggggtggtcttccttcactgtctgcgggacagatggaggggcacagctgcccatggacccaggctctggggcttctggaaggtgccgaggagggcaggtgcgatgcctgggggcgttcagcaaatgcctggccctgccccctgtgccaacttggcctgggaggctcaggcacagctgtttcaagggtcctttatttcattcctggttcatttcaaagtgtctgtgtcttgttcggagcagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggaggtgagcgagggtcaccccggcctgttctccaagccctggtgcggtgcagacgctggggactgcagtccctgccctcctgccacagctcacatctggagaggcaaacatgtatcacacaccggacaatgtgatgccatcagaggcgtggggtgcatgaggcaaagggactggtacccttgaaagaagggaggtcgcccgtgtgtgcctggaactacagagccacggggtggagatgactttgccgagacgggagttgaaatgtacatgaggacaggctgccccctgttcccttgtcaccaggaaacaatttgaaatctgctaaatatcctcctgtgttacactctagaggtgattgtttgctttggatctaggcctgggtcaccttttcatggcctgcaggttcagggagctctatgccaggacgggccacgatctaggtgggaaatgaggcaggtgacccatgtgaccacaccacagattgcccatgtgcaggaagcgggaggggaccctggccgggtaccctgcctccattttccctccagctctccctctactactgacggccatccttcagccttccttgtaggaaatgaccttcactctgggtttaactggagtggcatcacctcccagggagacagttacttcctggaggaagtggtgtttcctccacccataggtgccctgcccccatcctcatggtggcagcaaatcagcatgtgctggggagaccctggggtagcagccactgacctcacacctggaggaagctgtgtgaccgattcatgagcttgtaagtggctcccagccatgccccaggagcagtgaggcaggcctgtgccctttggttcaggatggaggttgtctcttcccgcctaacctctcacctttgtgctcaccttccagatgcctgaagacagagcaagcactccccgcaccagcgacgatgacgttcacttgttttgtgtttttcgatctcttcaacgccttgacctgccgctctcaggtgagacccgggctgaccctcctcgctgcagagctgctgtgtgttctcgacagcagcgtccccgaccctggcccgcagcattgagcggctctggcgtcagcgtgggcagtcagagctcccctgcctgtacctggggtgtggacagcacacaatccccgtgtgaccttctccctgcagaccaagctgatatttgagatcggctttctcaggaaccacatgttcctctactccgtcctggggtccatcctggggcagctggcggtcatttacatccccccgctgcagagggtcttccagacggagaacctgggagcgcttggtgagtggtggggacgggaacgacaggtgacctcgaccagggccatggggggcggcagctgccaggtggggagctgcagcccaggaggggtcagtgcgggaaagcagagctcaccaggggccggctctgtcttcagggcccttctgtcctcacaggaagggactctaacgtgggtgatgtgacggatgcacagaaacccctaggaagaggcctgtcactcaagagtagtagggtctggggcccaaggggcaccggcatcccaggcgtcgggctggaggctcagagcacgtgcagggaggaaggagggagcaaggcctgtactcagcctgggaggtaccccagctggggagcctggacttgaccctggggccagtaatgtgacttagagatctggtcacctgaaggcagggagctggctgtcttccagttttggctgaaagggacatgattcagtcaccgtggttttccaagggcacacgccctggtgtggagcccaggggactccccgacattgtcagccaagcgagtgtggcacctttctctgaagctgcggttatggcaggcatggggcaaggggagggagccagggacaagtcatcgaccccacccttttccccagtgtgctgagagccaaccccaacccggaatagaggacgagggaggccagtgaggcagcccccatgggcccaccgcctccccgccggcagggcccagagtgggtcatggctcagatctggagggtcatgggattatgcatcagacctgaggctgcagtgacaacggtcctatgacctccaggcaagactgggatggtcaactctgccttgtcctccaaaaagcagtgtcagtgtgggtcaccagtgaatgccctgtaggaacagacaagaggaccccccaaaacactctgctcactggctgtttccacccgccgggaaggaagtcggcttcccacgcctgaaggggttgtgcttgggcagcccgtacatcaggaatcatcaacagggagccagggatggttcctcaaaacagcatgtgacaggagcagagggagacgctgggaattcatcccagggaacatgtcgctgggaattcatcccagggaacatgtcggggtgcactggacagggagcccagactggtcactcaggacatttgcaagcagcagggcactgggacagctgctgtagggaaaggaaactcattccccttccagcccgagtccataacatgctcccagctgcctgccagacccaccctgtgctctggagctgcctggtgtttgcctggaaccacaggcaggcccttctggaactgcagcattttggattctgggttaggaagatctccctgccttaggggaatgaaaagggctgtcctcgcacctctcacttnatcaggaggactggcagggaaggcgcttctgccggcgcacagagctgcagcccgtcctgaatctttctgtttctcccttggcagatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggcacccaggcccacatccatccagtcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataattattttgatgtgtttacctagggtttttaatacaaggggccaggttggaaacccacagccatgtgttaatggccacgtggggtgagcagcaatccatcatgaatggcctacaggaaggcctcggcttttggacataaagagtagggctgggcatggtggctcacgcctgtaatcccagcactttgcaaggccaaggcaggcagatcacttgaggccagcctggccaacacagcaaaaccctgtctgtctctactaaaagtttaaaaaaaaaaaaaaaaacagttgccaggcgtgatgatgcacacctgttaatcccagctactcgggaggctgaggcaggagaatggcttgagtccaggaggtggagattgtaccactgcactgcagcatgggcaacaaagcaagagtctctctcagaaagtggcccttctctccggaaccaggaactgtagtatctcctgctgcctgcagacaagcttgatttcccactgccccaaagacttccaaaaaccgatctgctcttccacgtgacagatggcagaggagagaggtctccatgctgttcttctgcctgaagccacgccagaaccaccaaagggaaccagaaggggaactccgtccccatctctcaggaaataaggccagagctagaaccccccatttactagtcaggcctcactagagaaacagaaccaacaggatggagggagatgcagagatttgttttaaggaactggctcataggatgttgggggctggcaagtctaacatcttgagggcaggccagcatcctggagacccagggaagagctggggatgcaggctggaggcagaatttcctcctcctcaagggagttcagccttttcctcttatagtcctcaactgatcggatgaggcccactcacgttatgaaggataaactgtttgttttacttcaagtctacgggcttacatgttagttacacagcgccatctagaccagtgtttgtttgacgaaaatcaacttggcctggccaagttgtcagataaaagtacccgttgcacccagccacggtagtatgaaaagggtagcaggggtggtaacagctgggtcagacgaagataaggaaggtcagagtggacccctgccagggttccaggcagagtccaaagtcctccatagtaggattcacagcctgggaagaagcccctctctggctacaacctgtgacaccagggccacaggaggagatgcagcgatgggccattcctagtgagacacagacacagggctggctggagaagaaaccttttgagctgtggggctgtcttcctagaagctgccaacccctggaaccactaagaggtcaaggctgaagtgtgccacttccacagtctgctaaggagtgcctccccctgagtcagggacaattcttgctctacttttcaggatccttgggcacactgctggcccgagacatttacttcccatttaaaattaagtaatcaaaataccagggtcgattactctgaactcttgcttatgtaaactttagggataaaactgtagtaagacacaaaatgctaacaataaaatataaattagactacattaaaactaagaccttcttttcattaaggacacagtagacttgaacaccaccattaagcaacttagcttgattacacttgtagaacaccccattcacgagtagcatagaaacagtcaccaaaataaagagcagaaatcaaacgaaaaagcaaaaatagaggaaaatcaatcaaaacctagtttttcgaagagatcaataaaactatcagtcttgcaataagcttatcaaagaaaaaagggaagagaaatgaccaatgtcaggaatgaaaaagtatatcaccacaaacccttcaagatattccaacaataataataaataatactatgtacatctttatgtacctaaattcaatcaattggatgaaataaaccaattgcttgaaaaccaaaaactaccaaaactcactgaagattaaatagatagctgaagttgaaacccttccaaaaaaggcagtttc

SEQ ID NO: 15058 - DNA, 801 bp, Homo sapiens
ttatgttcagtgaaaaaggcagacacagaaagacaaattctgcatgttctcactgatgtatgtcagctaaaaaaaaaaaaaagtggatctcatggaggtagagaaaagaacgatagatactagaggatgggaaggatatatgagtgggagggagggagcaagagatgttggctagtgggtgcagggagccgaaggcccgtgggacgtgaccaactcagcattccactggaggctgtgtgatcaaacagcaaactgtttatcatgaatgcaggatgtgggcaaactcatgactgctcctgccaacaggtttgctggaggcgatcactccctgtcaccaaggttatctactgcgacatctagagcctgttgtttgaggaatgcagtcttgcaagcctactccggactgagcagctgaccccttcttccaccccccttctcactatgtcttttgcataacaaatacggagggctgtgtaaagttcagggcccttgtccactagaggcaaggtgccccctgaccccttcttccaaacatactcttttgtctcttgtcttttattcccatgttcgccccctttgttcggtccccctaggtccatgaggattacttagttgcaccccaaacagcaacagaaccgggtgccccacaagtgggtacaaacatacagttagaagagataagttctcatgttctatagcagcactgggtgaccagagtcggcaacaatgcactgtgtatttcacagtagacataagggaagacttgcaatgcttggaatgtggaaaggatactcaagttga

SEQ ID NO: 15059 - DNA, 290 bp, Homo sapiens
ccaacacaacattcaaatttaaagaggaaacagtatgggaaattcaggcaaaggatacagaaaattcattatattaacttaccacatgaaaggacacaaaacctcagtgattccaaagagtagatctaatatagatgacttcttggtcgggcatggtggctcagacctgtaatcccagaactttgggaggccgaggcggttggatcacttgaggtaaggagtttgagaccagcctgggcaacatagcgaaaccccatctctactaaaaatacaaaaattagctgggcatg

SEQ ID NO: 15060 - DNA, 2836 bp, Homo sapiens
gggccggcgtcgggcggggccggcggggtcttcagggtaccgggctggttacagcagctctacccctcacgacgcagacatggcagcgcagaaggaccagcagaaagatgccgaggcggaagggctgagcggcacgtgagcgagctggctctaggccctcggaccagagacccgggagtccgggcccccggccccctcctccctcctccctcgagagcctggagtcccagccccgagccgcagaagtgttggccccggtctcctctaatgggaccctggagtctgggcccctagtcccctccctgcctgctgtacaggaatctggggtcccgggagggagtccaggcacccttagtccccttcttttgcgggggtctggggctccatcccggtccaccactgacccggccccaccccccgcaggaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtgtgagtgcctcccgggccccgcacccgcactagccccgaccggctggacccctcctctcgccgctcaggccccgcccttcaccgcccggtccctcctctcaccgcccagggccctcttctcaccgcccaggccccgcccccaaggattggctctgctagactaccttgtcaccaaagggccaggtcccctaccccaccatcaccctggccaggatgcagtgtgactaaatgtcacctggccctccctggtctccaggatgtagcttgccgcccgccggtggagaaggccagggccgtcgggctggcccagccccagctgtctaaccgctgcctccctgcactcctcctccagggtgacgtcccctatgttgctggtggctctggctgtctttttcggcgcctgttacattctctatctgcgcaccttggagtccaagcttgtgctctttggtgagaaaccccctgcccagatgaatccttggtccctcaaatcttggtcttttggaatgcagacagacctcagaccccaaatccaagtccttcaaaacccaagtccgcccaagcctagatgtacactagatcccccaaacctgatcccttaaaatctcagacacaaccgatccttccatcgagtctcagccccctcaaattgctattcctcaaacccaggatccacctggctgctgtgccttaaacctactccttttcaaaccacatgactcctcccctctctctcctccccttgccgctctctgcggccaacatcagctgcaggtgcccacactggacaccaggtggccaccttacactggcctagatctgttcccgtttcttttcctgctttctggggtgtgaccagaaagaacttggaacttagagagggaagccgaggagtatgtttcatgtggttcccagactagtagtaccaaggaccactgggaaaacaaaatgccaggggaaattccccccaggggaaaatcaaggtttggagtggggtcagggagttgggattggacagttaggtagacctgaaggccaggctcttcaggggcctgcaagttatgtgcttgatgggctggggtggagggagtgcctgaagcacaggcacgacttggcttcagctgatcaccgtcaccagagcatgtagaccccatccctgagacttctatgagaagcctgaagttggtatttttatgtgaaatcgttcactttgccagccacaaatcacatccttgcaaaacagctcaaaaaacacatccacaggtcagatttggcccttgggccaccagtttgagaccctggtctgcgcgagggttgcagcaggagagccctagtctagggagcaggaagccgggatcccaggaacttcctggaggatgtggggcagagggcagagggtggggctgaggcaggcgaggacggtgtgctgtgttctggagggcagtggggacagcaggggaacagggtgaccccaggacctggagggccttggcatgaggagtttggattcgatcccgagaacctggagcttgtacggattgttggggggcagcaggggttactctgggagagggcatggagagtcggaacagcaccccaatgccatctgcccccaggccgagaggtgagcccagcgcatcagtatgctctggctggaggcatctccttccccttcttctggctggctggtgcgggctcggccgtcttctgggtgctgggtgagtacagggtctgagcagctggggtggatggtgggagccaggtgcaggagtgtggccctgagctgccggctttcctgcaggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaatattcccccagcatcttctgtgggtctctatgggtggagctgggaatactgcacagagcagggttggggtggaacctggggtgtgggcaagacgatgacaaggtaaacaggtaaaatattatgggatgcccaatggtggtgagtgtt

SEQ ID NO: 15061 - DNA, 167 bp, Homo sapiens
aaaaatacaaaaattagctgggcgtggtggcgggcgcctgtaatcccagctactctggaggctgaggcaggagaatcgcttgaacccaggaggcagaggttgcagtgagccgagattgcgccattgcactccagcctgggcaacaagagcgagactccatttcaaaa

SEQ ID NO: 15062 - DNA, 591 bp, Homo sapiens
cactcacagctctgatttactctcatcaaagggtatggagccaagtcagccaaaaggaaaggtgcatggagtgaactcgggaaaccaggcatgcacttccagaggccacacctaattcctccagcagtggatcatggtgacgtgtgaaatgtcagccagggacactctgatcctagcctcagcgcccttggtttcatgggggcggccacaagagcaccttctctccaacatataccaaaatgccaggctcccagaaagaaggcctgtgcctgcacgaacagcctagatagatgcagcaagccactctaggcctgcacgaacagcctagatagatgcagcgagccactctatcaggaagtgataagaccccccccccaacacccaagttcccagccaaggaccaactgtgcacccaggcctgtctaaggacagcagtctgttgtggagcctgccaggttaactcttttctgcacagagaaagttcgggaatgagttgtgggttaaagagggtgaccagaaaaggcctccctgacgtgacattcaccaaagacctaaattgagagagggagcagcccagatcctttggaggaa

SEQ ID NO: 15063 - DNA, 2110 bp, Homo sapiens
  misc_feature (847)..(847): n equals a,t,g, or c
cgtgcccagcctagtcatgactcaactgggatctggcacactgcactgggtgttttgttctctgatgtgcacattgatgaatgcatattggtacaagggaaatgaatctgttttcagccatttaaaaaattgtgttgtaaagcaaacaaaaatagcttgaacatttaaaaattactgtttaatattgtttgactgattttctaagaattatgtgaacaatgatgagtccagggcagcagccatcacaaatatgacagtccagcaaggcccatggaggtccctttggaagggacttgcacagctgattttctttttccagtgttgtttttacgggtgaaacgtggcttttgaaatactttagttgtttggcttagagctcccactttccccctaacatagtgcctgtctgttttttaaaacattttacccttcggcactattttctgctattcccattaatattatgtaacataaaccacttgctactgatttgggcatattacagactacaattactagttgctttgaatgcattggcactcttaattattgcaaaggagaattgaaaagtagtcttgtggtcctagttaatttagctttgggcaaactaagtggcttttcttctgtcctcttctcaaaaggccttttaagcagcagagactgggctaaatactggaactgaattccacttttctgcctgctcatttgctgccaaagaccacttggggctccttgtctagaatgctctaagacgaaatttggccagacacagggttccttgattgttctgttcaactaatagagaacctacattttgccttcttaatatcgactttcttttgtaccnaggtttttctttctttcttttttgccttaggagcttagctcaaagttcagctaacctttgacactactagtgtcatttagtaacagtaatctttgacactactagtgtcatttaggagcttagctcaaagttcagctaacctttgacactgctagtgcgttcaagaaagggtagggaatgaagtacccttaatgcagggtcagcaaacttttcctgtaaaaggccagataggaagtatttttggctttttgggctgtttgcttttgctactactactgtgggaatgaccatggtcatggctgtgttccagcacaacttgatttaccaagacaagctgtgggctgtatttggtcctcaggctgtggcttgctagcccctgctctaatggattgtgttggcggcaatggcaagattcccttgctgagaacatgcagatgaataaccttatagctgggatgcagagaggagaaagttctgtaggtaataagtgcactgtattccctctgagctacttcctgggcatagttacatgtatggccagtgtgtgtacttgagccatcaggctcagacacttgttgaatatacctctcattgcattagtttgtaattgtgctagtgctgggtgctgagctcagctgcccggatgacctttccagactgaaggacatactcccctaacagctgggagtgctgctggctggccatttacttccagcccttatgaggagtttcccctgctgaagagccctgcctgccccagatcatacccccttcctgcctgtaacccttaccggctccatatggggtacaaagggctggcctcctcaccccaacttgggaaaccctctggggccatcccagctccagagccccttgtggggtcagtgagacctcattgtggccacattacagcccagtgcctctccctgacaagcctgtacccagccggctcagcccacagcactgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgtatcatctg

SEQ ID NO: 15064 - DNA, 696 bp, Homo sapiens
gcaagtccaagatcaaggtgccggcagatttggtgtctggtgaggcctgtttcctggttcacagatggtgacttctacatggtagataggttgagggagctctctgaggcctctattataagggcactaatccctttcaggatgcccctcccccttaatcacctcccaaaggcttacaggctcacttaccaccctcctagtgttatcaccttgggggtaaagatttcaacacaggaattttgggggtcacaaacattcagaccatagcacttaacctttattttaaaatgtcagccaggtgcagtggctcatgcttgtaatcctagcacttagggaggccaaggtgggaggattgcttgagctcaggaatttgagaccagcctgggtaacatagtgaaaccccatctctacaaaaaataaaccacattagttgggtttggtgatgggtgcctatagcagcagctacttgggaggctgaggctggaggatcacttgagcccagaaggttgaggcttcagtgagccatgattgagctactgcaatccagtctgggtgacagagtgagaccctgtctcaaaaaaaaaaaaagtcaattatttaaaaactcattagtcaaatattttctaagatccaaatttgttttaagcaattataattgtcttcattgtgtcttctattggaattgtagctgagatt

SEQ ID NO: 15065 - DNA, 3146 bp, Homo sapiens
cccctgctgcgtgagaggtgtcggcggctccgggccgggatcgaggtggcggggcgagggaaggaggtggggcgcaggctgcattgcgcttctgtccggggccctgggtcagaggggccggcggacgaggcctcgggtccgggcttggggagggggcggtctgcggggtcggattgagggccgggaacccgcggagtcttgcccctgggcacctgtggggccgagatcccgagccacctgtccacacacccccttcccccagtgccctgcgttgggtccagctggccccagacctaggcctttcccagcctcgggcgattatagtttatttgaaaacgtttgatttttgtgttaatgattcttttactaccgccgtgcaacagttgtgtaaatgtggtcgtgttacgccatcgtttttacttgctcctaagaagggccttaccagctcctgcgattatctcacgcgatgattcttggtagctcgtgaaaaaaatgcataacaagatactggttctcaagggaccaaaaccccacccccacctaaaggaaatagcttgtttttgtttttcttttttacagcaatatgctacgtgtggggagggggagggacgatggaggcagcctgtagcgatctcatcctcgagagaatctgctaacaatttggggggtatctttccttcctttttaattaatacacaaacatatatacgtgtgttacataaggggtgtttatttgcttttttcacttaatacgtggaagaccttttctctatcgtttgaacctaaagcctagaaggcaagaaagcaactcgttagagagttgataaagtatcactgcagtggccagtgatttggatagaaataagctgaattcagggtaagaactggtttctataaaatatggtttactctgcataataattggaggcagtgttttttcaaactgagttttttcagccggttcgtgaatggtgaaattaatttagtcatgactagcatttaaaaaaaaataagatcgcataaaaaaatcagaatgcattatatgtaatgagagtattgttttgtgaaaaatattttaactgtgcgcgtgtgcattgtgaaatttagtgggtcgtgactagcattaaaaaaagtaagatcgcatagaaaatatcagactgcattacatgtaatgagagtattgttttgtgaaaaatcttttaagtgtgcgtatgtgcctgtgcgtgtgtgctcggttgtaattaaaaatttattggttcctgtgtgtcatgttaaataatcttgagagtcgctaatccaaggtactgtcagcactcaaatgagcaagatgcaattaaactagacattagttttattttttctttggaatagtggtgatgttgattgcagcaaataagagtcctaattatttgttttcacctaatattaaaacaagtagtattcctaaaaatacagagaggaagtgtctaagtcgttaagaggttaaagcataaactactcaaattgaccagtgatcacatctcagttacgctggttattggtgtgagacctgcaacaagatacctcttttctctcaacctcagttccctgatttgttaaatgggaattaatcatggcagctaccttataaagctgtttgttatttagatgagataatgcacaggaagctgttgacagagcgcctggctcagattaagtactaagtattagctattattattttattaagactgaatagaggtgtctaggataatgcttgtcaccagaggaaagccagcatagcgtggataatccagaaaaggggaaaattgaaaattagtagtgttgtgtggaggaactgacactgaattagtgtggtctttttatgcattcggccattgttttgtcattgctcctcaattgtttccctactgctggacggaaaatttagattgtcttattcagaaaaccaaatgcctttctattgtctttccttattattattatttttcaaattaagttgatgtctcttttgtcaggcagttgaaaaatatgttttatgaggattgtgggttttgttagttcttaccacactgccacgccacactcagtttgagaaatacacacacgacaactccagactcatttcagaaatatttttatccatgtttacctctgcagctggtgcagatctcaggtgtgcaagaaatatttctttaaaaaaaaaaaaaccaaaaacaaaatgctgttttatttgtattttaagacatttctgcctaagtcatctgggtagctcagaaatctctgttcactgcctgggataggtttatgcaattttaaatgttacataaatgaatgaaataagaaggtgaacatagtcattttttaaaaatagcattattatttttatgaaaaataaatagaatgctttggattcataaaaaggctatatttgcaaagtacttaactgggtatgacattggggaaaaatgtttaacattgatgataattctgctctcagatttgaaactgccttcagatttttgttctgctttagaggaacaaaaatggaaactcgggtgaattacgatgttgtttgtgaaaagacatgtctcgaaactctagctaatctgtccaaaaaaaaaaaaaaaagcaacagtccccatactaaaaataccaatgaaacaaaaaagccccatttgatcttaaacatatatacatttagaagttttaagttaaatattaaggttatgtgtgcatttaaaaaattatcttactgattgactttaagaagttaacccaccaactactggttcttgtcttgacagggcttttatctacactgacaaaatgaaatactatgcaatcattaaacattctattttattttactctattttctcctattttatgatagcattttataatggtatatgaaggtgctcattatatgtggttcagtgagagagggtggctatagaatagaatgtactgtaccttcccatttttgtaaaaatatgtttagaacaaagacgaatacgatacatgttaatggtgggtagattatggctgatttttatgctctttatttttataattgtactattataaatgctttacttttgtaataaaaattaataaaagtcattttttaaagaaaaattaaa

SEQ ID NO: 15066 - DNA, 9880 bp, Homo sapiens
aggagagccaggtcctcctgactcttacaaatccagttgagaacctcacccatgtgactctcttcgagtgtgaggagggggaccctgatgatatcaacagcactgctaaggtaggagcattttgcctcagcctgactgacccgcactttccctggagtgtcctcatttgacctggcttaaaagactccacacactctcctttccacatctagtcagcaagttcttttgattccacctcctaaatttttttactttatcctgaaacacactgccctatttgaaggtctcatcgtttcttacctggacagtgacaataacttcctaaatgaccttgctatttttataccaccacctctgtttcaacccatttcttctctcttgccaccagggtgatacttctaaaatctaactctgtgcatgctggtcatttagcattgctcttgactgagatgaagtccagatttttggcatagcataagagctgcttaatgacattacttctctgttcttccagtgtggtcttccttcagatcctcaaatttagcattccctgaatcgtacatattagtggttgtgatccagacagatccaatgggttataaactttgacactggagaattgtgtatgctattcattttacttagcatgcctccttcctatcctgactcccctaacatacatgccccttcagtctctcagtctcatacattcattcttcaacacttgtgaaatatcatttccttttagaaatgatacgtttaaaatcatttagaagctggtatgcctcctctagattcctctaccttacaaagagtatacataacatagcactaactagtctgggcttggtggctcacgcctgtaatcctagcactttgggaggccaaggtgagtggatcatctaaggtcaggagttcaagaccagcctggccaacatggtgaaacccgtctctactaaaatacaaaaattagccgggcatgatggcagatgcctgtaatctcagctactggggaggctgagatgggagaatcacttgaacccgggagacagtgattgcagtgagctgagatcgcgccactgcactccagcctgggcggctgaggtgagactccatctcaaaaaacaaaataactaaatgttaaagtaggtgattttgactcagtgtgagttgaatggatgtaatatggcctctctttatattttgctacttctagtacttgaaattttagaacaagagcctttctctatagatcatctattactaattcataattcagcatgatatttataatagaaatggtttaaaaagatgcctatatctttagttcttattcaaataatattagagaatttctgtcctctttttttttttcttctgctttttaatgatttcacttactagcatcacctccaaagagagataacacttatttcacttatttggtccttgttgcttttttttttttgagacggaatctcactcggtcgccaggctggagtgcagtggcgcagtctcggctcactgcactctccgcctcccagtttcaagcgattcccctacctcagcctcccaagtagctgggattacaggcgcctgccaccacgcccggctaattttttgcagttttagtagagacggggtttcaccctgttggccaggatggtctcaatcgcttgaccttgtgatccaccttcctcgggctcccaaagtgctgagattacagatctgagccactgtgccctgacgttcctttttttattaacactaataagcagctccagttaagacagacagaaataagtacctgatgcataagcacagcatatctttataaagctctctttatacctcccctcccacatttgtatctataattagaaatttgatcaacactgttaactgttaacctctgatagagcaaagttgaggcctaattacaacataagtctgaagaatgctaattgttttccatgaccataatcacccagtatctcatgtaagtttatgtatcaggtaccaggaatcagctggtaccatgtcaaaaaacattgtgttggaaccagtgtttctcctttgtgttgttcttaatgatggactgtttcagatgtatcaaaaaaaaatgaggaataatatggcaagtacccatttctccccatccccttaagaaattaaacattagggctaggcgcggtggctcacgcctgtaatcccaacagtttgggaggccgaggcaagtggatcatgagggcaggagttcgaaaccagcttggccaatatggtgaaaccccgtctctactaaaactgcaaaaaattagccaggcatggtggtgggcacctgtagtcctagctactcatgaggctgagtcaggagaatcgcttgaacccaggaggcagaggttgcagtgagccgagatcatgccatttgcactctagcctgggcgacagagtgagactccatctcaaaaaaataaataataaaataaaacattaaagacacaattgaagcccccatgttctccccagttcctcattgcagaccccatgaagtaagtactaacttagctttctcttaaaacctttgttcttataaactccatagaagtagtatatgtttcctgaaacttgctgtgtgcttccatttgtctaaatcaatgtcgtactttgctatattctgtcacactggtcccttctcaggcaggcctctctgtgttgctctccaggtggtggtgcctcccaaagagctcgttttagctggcaaggatgcagcagcagagtacgatgagttggcagaacctcaagactttcaggacgatcctgagtgagtgatctttttgtgatccccatacaacaaatggctgataatagaatgcccacttatatccagttttcttgtctggattttttaaaataacttttttcttcctgtttctaaaaataattattgtagaaaattggggaaatatatgtaagaccatgaagaagaaaataaaattatcccaccaccagagataaacaccattagcattttggcatttgtccttccaaatatttctcacctcattgggatcattctataaatacagttttttagcctttttcacttgaatatattttcccatgttaataaagaaatttttaattatatgattttaatggttgtggacaggatacaatactctgtccctagagattgatcatcgggtttgttccccacccccacccccttggaggaattaatagattttactctctcatatctaataactgaaaagaaccaaaccttccagtaactggggactgtgaccatcagagaattcagtctgtagactgaatgttttcaatgattcgaacagaggatttaatataaataattgttcacttgtgtaacttaaaaagtgaaaaagaacactgaagtagcaattttatgctacttcatgggcataaaatttcaaagatagctatttgatgagccagctaccaccccttaggtggagggaacaaagggaaatagttagaattattaaaatttagaacttaaacaaagagctccatgtagctgaaactcaggcctccagtgagctgaaggggaacactgcttgcgtggtcctggcatctcgtgatggcaaaggaggggtggcatgattatacaagaattggaaaacttcaactgcttactgccacttcctcctgggtaaagaagcattgctgggccgggcatggtggcttacccctgtattctcaacactttgggaggctgaggcaggaggattgcttcacaggagtttgaaaccagcctaggaatagagttaagactccgtctctacaaaaaaattttaaaaatagccaggtgtagcagcgcatgcttgtagtcccagctactcaggataccagggtgggagaatcagttgagcccggtaggctgaggctgcagtcagctgtgattgtgactgtactccagcctgggcaacagagtgataccctgtctcaaaaaaaaaaagacatttttggagtgatggccacagggaacagggaccacaagcaaacaggaatctctaaaggaagagcaagacccttcctcctccagacttctagtctccctttagagcccgctgctgacagaacctgacaaagagccatccgatccagcagatacagtccaagcagaatcctgtgtcacaaagcaaaattgagagaggtgcgcttggagctgaaaaataatagcttagtaaactggcacagggaacattcacagtctttgttttgtttttagagaaggagtctctgtcgcccaggctggagtgcaatggcgtgatctcctgctcactgcaacctccacctcccgagttcaagcagttctcctgcctcagcctcctgaggagcttgtattacaggcaagcgccaccacgcctggccaatttttgtatttttagtagagatggggttttgccatgttgcccaggctggtcttgaactcctgacctaaagtgatccacccgacttggtctcccaaagtgctgggattacaggcgtgagccaccatgcctggcccatttacggttttttgacagaatgatcaaaagctttctcaacaagatattagagagaagagataacaaggtgggttagaaaaataaagtgaagccaggtgtggtggctgatgcctgtaatcccagcactttgggaggctgaggcaggcagatcacttgaggtcaggagtttgagaccagcctggccaacatggcgaaatcctgtctctactaaaaatacaaaaattagccaggcgtggtggcacgtgcctgtaatcccagcttcttgggaggctgagatgggagaatcacttgaaccctaggggcgggggttgcagtgaactcagatcacgccactacactccagcctgggcaacagagccagactccgtctcaaaaaaaaaaaaaaaagaaaagaaaagaaaaataaagtgaaggcaaaggtgagattagtttagtgataccaaacgtgggttaacttcagaaagcaccaggtcaagtgttgttttgttttgttgttcgatagcattccagaccctaaccccagaggattttttttagcaggtctagctagggaccagaaatccaaatttgttttggaaaagcttcccaggtatcagtggttgcctgggaaattaaggataaaaagaaagactgatgtttttctttttaccattttaaactgtttgaattattttttacatgactcatacaaatcaaaggtctggttagttactgtaatacaaaatgtgctgagttgtacagtacaaaatgtgttctctcaaatccttgctttatgtgggtcctcaaattaattaggtacagaaatttgttaagccaagatatacttctggaatgattgtctgagatatcagatttcagcctgattacatgatagagtaattaaaaactgaattaattatattttacattattagatttaatagaactttcagatttctggaaactaacactgtataaatatgtaaatatgtaatcccagtaacctttcttagagtaactgaatgtcatttgggtagtagacaaattctgtttatttcattgcccttttactttcagaaactaagttattaaagcacaaactgtatgcacaaatgaggggaaattgaaatgcaaacctcaatgaagagacatttttgtgctaaaattcctaattacataagttatttacaaaaacattcttgatttatggtgttccaaaatttcccttaaagcactgagttattaaaacttcccacagtatggccaggcatggtggctcatgcctataatcccagcactttgggaggccaaggcagaaggatcatttgagcttaggaggtcaaggctaccatgaactatgatcgtgccactgctctccagcctgggtaacagagcaaaagccttgtctctaaaaaataaaaataaggccgggtgcattggcttatgcttgtgatcccagcactttgggaggctgaggcgggtggatcacctgagatcaggagttcgagaccagtctgaccaatgtggtgaaaccccatctctactaaaattataaaaattagctgggcgtgatggtgtgcacctgtaatcccagctactcaggaggccgaggcaggagaatcgctggaacccaggaggcggaggttgcggtgagccaagattgcgccactgcactccagcctgggtgacagagcgagactccatctcaaaaaaataaataaataaataactttccacggtatgagtctatgttctatagaaatattgcatttgcacagaggtaaatgtaaagggatgtttgcagcaccattgtttataatagagaaaagttgtcagcaacctcagtatatgccaattatggtaaacacataattgaatactgtgcaaccattacatagattgtagatgatctgtatataccagcgtcaaaaggtgtttgtgataaacagagttaaaaaaaagcaagttatggaatagtgtgtaccatctgtgttggttagaaaagcagaaaagtataagctcatagaaaaatatatggccaacgtgttggcttatgcccgtaatcccagcacttttggaggccaaggcaagcagatcacctgagccctggtgttcgagaccagcctgggcaacgtggcgaaaccccatctccaccaaaaaatatacgtattaatatataaagctagccaggtgtggtggtgcatgcctgtagtcccagctactcgggaggctgagatgggagagttacttgagcccgtgaaacagaggttgcagtgacccaaggtggagccattgcactccagcctgggcgacagagcgagactgtgtctcaaaacaaaacaaaaaaatacttggtaggttaagaacaaagtgtttataggttttctgtgtgtgctgaaggaaagaataaggtgaaagacttttactgtaagtcttagtggtttggctgatttttttatctacctaatacttgcttttttttctttccatagcattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttgagcgtgtcttttgtttgctctcatgtagatactaagtagcatggctcagagccaaaagacaagcgtgaagttaagagagttggctaagagagttggtggggcatgctcccttccattccttaaatgaagtaatctaaaatctcttagcaggttagttcaccataatatataagtagatgttgctttgagcttcttatatacatattcacagaaccattatataaatgttgttagacctcta

SEQ ID NO: 15067 - DNA, 9879 bp, Homo sapiens
aggagagccaggtcctcctgactcttacaaatccagttgagaacctcacccatgtgactctcttcgagtgtgaggagggggaccctgatgatatcaacagcactgctaaggtaggagcattttgcctcagcctgactgacccgcactttccctggagtgtcctcatttgacctggcttaaaagactccacacactctcctttccacatctagtcagcaagttcttttgattccacctcctaaatttttttactttatcctgaaacacactgccctatttgaaggtctcatcgtttcttacctggacagtgacaataacttcctaaatgaccttgctatttttataccaccacctctgtttcaacccatttcttctctcttgccaccagggtgatacttctaaaatctaactctgtgcatgctggtcatttagcattgctcttgactgagatgaagtccagatttttggcatagcataagagctgcttaatgacattacttctctgttcttccagtgtggtcttccttcagatcctcaaatttagcattccctgaatcgtacatattagtggttgtgatccagacagatccaatgggttataaactttgacactggagaattgtgtatgctattcattttacttagcatgcctccttcctatcctgactcccctaacatacatgccccttcagtctctcagtctcatacattcattcttcaacacttgtgaaatatcatttccttttagaaatgatacgtttaaaatcatttagaagctggtatgcctcctctagattcctctaccttacaaagagtatacataacatagcactaactagtctgggcttggtggctcacgcctgtaatcctagcactttgggaggccaaggtgagtggatcatctaaggtcaggagttcaagaccagcctggccaacatggtgaaacccgtctctactaaaatacaaaaattagccgggcatgatggcagatgcctgtaatctcagctactggggaggctgagatgggagaatcgcttgaacccgggagacagtgattgcagtgagctgagatcgcgccactgcactccagcctgggcggctgaggtgagactccatctcaaaaaacaaaataactaaatgttaaagtaggtgattttgactcagtgtgagttgaatggatgtaatatggcctctctttatattttgctacttctagtacttgaaattttagaacaagagcctttctctatagatcatctattactaattcataattcagcatgatatttataatagaaatggtttaaaaagatgcctatatctttagttcttattcaaataatattagagaatttctgtcctctttttttttttcttctgctttttaatgatttcacttactagcatcacctccaaagagagataacacttatttcacttatttggtccttgttgcttttttttttttgagacggaatctcactcggtcgccaggctggagtgcagtggcgcagtctcggctcactgcactctccgcctcccagtttcaagcgattcccctacctcagcctcccaagtagctgggattacaggcgcctgccaccacgcccggctaattttttgcagttttagtagagacggggtttcaccctgttggccaggatggtctcaatcgcttgaccttgtgatccaccttcctcgggctcccaaagtgctgagattacagatctgagccactgtgccctgacgttcctttttttattaacactaataagcagctccagttaagacagacagaaataagtacctgatgcataagcacagcatatctttataaagctctctttatacctcccctcccacatttgtatctataattagaaatttgatcaacactgttaactgttaacctctgatagagcaaagttgaggcctaattacaacataagtctgaagaatgctaattgttttccatgaccataatcacccagtatctcatgtaagtttatgtatcaggtaccaggaatcagctggtaccatgtcaaaaaacattgtgttggaaccagtgtttctcctttgtgttgttcttaatgatggactgtttcagatgtatcaaaaaaaaatgaggaataatatggcaagtacccatttctccccatccccttaagaaattaaacattagggctaggcgcggtggctcacgcctgtaatcccaacagtttgggaggccgaggcaagtggatcatgagggcaggagttcgaaaccagcttggccaatatggtgaaaccccgtctctactaaaactgcaaaaaattagccaggcatggtggtgggcacctgtagtcctagctactcatgaggctgagtcaggagaatcgcttgaacccaggaggcagaggttgcagtgagccgagatcatgccatttgcactctagcctgggcgacagagtgagactccatctcaaaaaaataaataataaaataaaacattaaagacacaattgaagcccccatgttctccccagttcctcattgcagaccccatgaagtaagtactaacttagctttctcttaaaacctttgttcttataaactccatagaagtagtatatgtttcctgaaacttgctgtgtgcttccatttgtctaaatcaatgtcgtactttgctatattctgtcacactggtcccttctcaggcaggcctctctgtgttgctctccaggtggtggtgcctcccaaagagctcgttttagctggcaaggatgcagcagcagagtacgatgagttggcagaacctcaagactttcaggacgatcctgagtgagtgatctttttgtgatccccatacaacaaatggctgataatagaatgcccacttatatccagttttcttgtctggattttttaaaataacttttttcttcctgtttctaaaaataattattgtagaaaattggggaaatatatgtaagaccatgaagaagaaaataaaattatcccaccaccagagataaacaccattagcattttggcatttgtccttccaaatatttctcacctcattgggatcattctataaatacagttttttagcctttttcacttgaatatattttcccatgttaataaagaaatttttaattatatgattttaatggttgtggacaggatacaatactctgtccctagagattgatcatcgggtttgttccccacccccacccccttggaggaattaatagattttactctctcatatctaataactgaaaagaaccaaaccttccagtaactggggactgtgaccatcagagaattcagtctgtagactgaatgttttcaatgattcgaacagaggatttaatataaataattgttcacttgtgtaacttaaaaagtgaaaaagaacactgaagtagcaattttatgctacttcatgggcataaaatttcaaagatagctatttgatgagccagctaccaccccttaggtggagggaacaaagggaaatagttagaattattaaaatttagaacttaaacaaagagctccatgtagctgaaactcaggcctccagtgagctgaaggggaacactgcttgcgtggtcctggcatctcgtgatggcaaaggaggggtggcatgattatacaagaattggaaaacttcaactgcttactgccacttcctcctgggtaaagaagcattgctgggccgggcatggtggcttacccctgtattctcaacactttgggaggctgaggcaggaggattgcttcacaggagtttgaaaccagcctaggaatagagttaagactccgtctctacaaaaaaattttaaaaatagccaggtgtagcagcgcatgcttgtagtcccagctactcaggataccagggtgggagaatcagttgagcccggtaggctgaggctgcagtcagctgtgattgtgactgtactccagcctgggcaacagagtgataccctgtctcaaaaaaaaaaagacatttttggagtgatggccacagggaacagggaccacaagcaaacaggaatctctaaaggaagagcaagacccttcctcctccagacttctagtctccctttagagcccgctgctgacagaacctgacaaagagccatccgatccagcagatacagtccaagcagaatcctgtgtcacaaagcaaaattgagagaggtgcgcttggagctgaaaaataatagcttagtaaactggcacagggaacattcacagtctttgttttgtttttagagaaggagtctctgtcgcccaggctggagtgcaatggcgtgatctcctgctcactgcaacctccacctcccgagttcaagcagttctcctgcctcagcctcctgaggagcttgtattacaggcaagcgccaccacgcctggccaatttttgtatttttagtagagatggggttttgccatgttgcccaggctggtcttgaactcctgacctaaagtgatccacccgacttggtctcccaaagtgctgggattacaggcgtgagccaccatgcctggcccatttacggttttttgacagaatgatcaaaagctttctcaacaagatattagagagaagagataacaaggtgggttagaaaaataaagtgaagccaggtgtggtggctgatgcctgtaatcccagcactttgggaggctgaggcaggcagatcacttgaggtcaggagtttgagaccagcctggccaacatggcgaaatcctgtctctactaaaaatacaaaaattagccaggcgtggtggcacgtgcctgtaatcccagcttcttgggaggctgagatgggagaatcacttgaaccctaggggcgggggttgcagtgaactcagatcacgccactacactccagcctgggcaacagagccagactccgtctcaaaaaaaaaaaaaaaagaaaagaaaagaaaaataaagtgaaggcaaaggtgagattagtttagtgataccaaacgtgggttaacttcagaaagcaccaggtcaagtgttgttttgttttgttgttcgatagcattccagaccctaaccccagaggattttttttagcaggtctagctagggaccagaaatccaaatttgttttggaaaagcttcccaggtatcagtggttgcctgggaaattaaggataaaaagaaagactgatgtttttctttttaccattttaaactgtttgaattattttttacatgactcatacaaatcaaaggtctggttagttactgtaatacaaaatgtgctgagttgtacagtacaaaatgtgttctctcaaatccttgctttatgtgggtcctcaaattaattaggtacagaaatttgttaagccaagatatacttctggaatgattgtctgagatatcagatttcagcctgattacatgatagagtaattaaaaactgaattaattatattttacattattagatttaatagaactttcagatttctggaaactaacactgtataaatatgtaaatatgtaatcccagtaacctttcttagagtaactgaatgtcatttgggtagtagacaaattctgtttatttcattgcccttttactttcagaaactaagttattaaagcacaaactgtatgcacaaatgaggggaaattgaaatgcaaacctcaatgaagagacatttttgtgctaaaattcctaattacataagttatttacaaaaacattcttgatttatggtgttccaaaatttcccttaaagcactgagttattaaaacttcccacagtatggccaggcatggtggctcatgcctataatcccagcactttgggaggccaaggcagaaggatcatttgagcttaggaggtcaaggctaccatgaactatgatcgtgccactgctctccagcctgggtaacagagcaaaaccttgtctctaaaaaataaaaataaggccgggtgcattggcttatgcttgtgatcccagcactttgggaggctgaggcgggtggatcacctgagatcaggagttcgagaccagtctgaccaatgtggtgaaaccccatctctactaaaattataaaaattagctgggcgtgatggtgtgcacctgtaatcccagctactcaggaggccgaggcaggagaatcgctggaacccaggaggcggaggttgcggtgagccaagattgcgccactgcactccagcctgggtgacagagcgagactccatctcaaaaaaataaataaataaataactttccacggtatgagtctatgttctatagaaatattgcatttgcacagaggtaaatgtaaagggatgtttgcagcaccattgtttataatagagaaaagttgtcagcaacctcagtatatgccaattatggtaaacacataattgaatactgtgcaaccattacatagattgtagatgatctgtatataccagcgtcaaaaggtgtttgtgataaacagagttaaaaaaaagcaagttatggaatagtgtgtaccatctgtgttggttagaaaagcagaaaagtataagctcatagaaaaatatatggccaacgtgttggcttatgcccgtaatcccagcacttttggaggccaaggcaagcagatcacctgagccctggtgttcgagaccagcctgggcaacgtggcgaaaccccatctccaccaaaaaatatacgtattaatatataaagctagccaggtgtggtggtgcatgcctgtagtcccagctactcgggaggctgagatgggagagttacttgagcccgtgaaacagaggttgcagtgacccaaggtggagccattgcactccagcctgggcgacagagcgagactgtgtctcaaaacaaaacaaaaaaatacttggtaggttaagaacaaagtgtttataggttttctgtgtgtgctgaaggaaagaataaggtgaaagacttttactgtaagtcttagtggtttggctgatttttttatctacctaatacttgcttttttttctttccatagcattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttgagcgtgtcttttgtttgctctcatgtagatactaagtagcatggctcagagccaaaagacaagcgtgaagttaagagagttggctaagagagttggtggggcatgctcccttccattccttaaatgaagtaatctaaaatctcttagcaggttagttcaccataatatataagtagatgttgctttgagcttcttatatacatattcacagaaccattatataaatgttgttagacctcta

SEQ ID NO: 15068 - DNA, 9878 bp, Homo sapiens
aggagagccaggtcctcctgactcttacaaatccagttgagaacctcacccatgtgactctcttcgagtgtgaggagggggaccctgatgatatcaacagcactgctaaggtaggagcattttgcctcagcctgactgacccgcactttccctggagtgtcctcatttgacctggcttaaaagactccacacactctcctttccacatctagtcagcaagttcttttgattccacctcctaaatttttttactttatcctgaaacacactgccctatttgaaggtctcatcgtttcttacctggacagtgacaataacttcctaaatgaccttgctatttttataccaccacctctgtttcaacccatttcttctctcttgccaccagggtgatacttctaaaatctaactctgtgcatgctggtcatttagcattgctcttgactgagatgaagtccagatttttggcatagcataagagctgcttaatgacattacttctctgttcttccagtgtggtcttccttcagatcctcaaatttagcattccctgaatcgtacatattagtggttgtgatccagacagatccaatgggttataaactttgacactggagaattgtgtatgctattcattttacttagcatgcctccttcctatcctgactcccctaacatacatgccccttcagtctctcagtctcatacattcattcttcaacacttgtgaaatatcatttccttttagaaatgatacgtttaaaatcatttagaagctggtatgcctcctctagattcctctaccttacaaagagtatacataacatagcactaactagtctgggcttggtggctcacgcctgtaatcctagcactttgggaggccaaggtgagtggatcatctaaggtcaggagttcaagaccagcctggccaacatggtgaaacccgtctctactaaaatacaaaaattagccgggcatgatggcagatgcctgtaatctcagctactggggaggctgagatgggagaatcacttgaacccgggagacagtgattgcagtgagctgagatcgcgccactgcactccagcctgggcggctgaggtgagactccatctcaaaaaacaaaataactaaatgttaaagtaggtgattttgactcagtgtgagttgaatggatgtaatatggcctctctttatattttgctacttctagtacttgaaattttagaacaagagcctttctctatagatcatctattactaattcataattcagcatgatatttataatagaaatggtttaaaaagatgcctatatctttagttcttattcaaataatattagagaatttctgtcctctttttttttttcttctgctttttaatgatttcacttactagcatcacctccaaagagagataacacttatttcacttatttggtccttgttgcttttttttttttgagacggaatctcactcggtcgccaggctggagtgcagtggcgcagtctcggctcactgcactctccgcctcccagtttcaagcgattcccctacctcagcctcccaagtagctgggattacaggcgcctgccaccacgcccggctaattttttgcagttttagtagagacggggtttcaccctgttggccaggatggtctcaatcgcttgaccttgtgatccaccttcctcgggctcccaaagtgctgagattacagatctgagccactgtgccctgacgttcctttttttattaacactaataagcagctccagttaagacagacagaaataagtacctgatgcataagcacagcatatctttataaagctctctttatacctcccctcccacatttgtatctataattagaaatttgatcaacactgttaactgttaacctctgatagagcaaagttgaggcctaattacaacataagtctgaagaatgctaattgttttccatgaccataatcacccagtatctcatgtaagtttatgtatcaggtaccaggaatcagctggtaccatgtcaaaaaacattgtgttggaaccagtgtttctcctttgtgttgttcttaatgatggactgtttcagatgtatcaaaaaaaaatgaggaataatatggcaagtacccatttctccccatccccttaagaaattaaacattagggctaggcgcggtggctcacgcctgtaatcccaacagtttgggaggccgaggcaagtggatcatgagggcaggagttcgaaaccagcttggccaatatggtgaaaccccgtctctactaaaactgcaaaaaattagccaggcatggtggtgggcacctgtagtcctagctactcatgaggctgagtcaggagaatcgcttgaacccaggaggcagaggttgcagtgagccgagatcatgccatttgcactctagcctgggcgacagagtgagactccatctcaaaaaaataaataataaaataaaacattaaagacacaattgaagcccccatgttctccccagttcctcattgcagaccccatgaagtaagtactaacttagctttctcttaaaacctttgttcttataaactccatagaagtagtatatgtttcctgaaacttgctgtgtgcttccatttgtctaaatcaatgtcgtactttgctatattctgtcacactggtcccttctcaggcaggcctctctgtgttgctctccaggtggtggtgcctcccaaagagctcgttttagctggcaaggatgcagcagcagagtacgatgagttggcagaacctcaagactttcaggacgatcctgagtgagtgatctttttgtgatccccatacaacaaatggctgataatagaatgcccacttatatccagttttcttgtctggattttttaaaataacttttttcttcctgtttctaaaaataattattgtagaaaattggggaaatatatgtaagaccatgaagaagaaaataaaattatcccaccaccagagataaacaccattagcattttggcatttgtccttccaaatatttctcacctcattgggatcattctataaatacagttttttagcctttttcacttgaatatattttcccatgttaataaagaaatttttaattatatgattttaatggttgtggacaggatacaatactctgtccctagagattgatcatcgggtttgttccccacccccacccccttggaggaattaatagattttactctctcatatctaataactgaaaagaaccaaaccttccagtaactggggactgtgaccatcagagaattcagtctgtagactgaatgttttcaatgattcgaacagaggatttaatataaataattgttcacttgtgtaacttaaaaagtgaaaaagaacactgaagtagcaattttatgctacttcatgggcataaaatttcaaagatagctatttgatgagccagctaccaccccttaggtggagggaacaaagggaaatagttagaattattaaaatttagaacttaaacaaagagctccatgtagctgaaactcaggcctccagtgagctgaaggggaacactgcttgcgtggtcctggcatctcgtgatggcaaaggaggggtggcatgattatacaagaattggaaaacttcaactgcttactgccacttcctcctgggtaaagaagcattgctgggccgggcatggtggcttacccctgtattctcaacactttgggaggctgaggcaggaggattgcttcacaggagtttgaaaccagcctaggaatagagttaagactccgtctctacaaaaaaattttaaaaatagccaggtgtagcagcgcatgcttgtagtcccagctactcaggataccagggtgggagaatcagttgagcccggtaggctgaggctgcagtcagctgtgattgtgactgtactccagcctgggcaacagagtgataccctgtctcaaaaaaaaaaagacatttttggagtgatggccacagggaacagggaccacaagcaaacaggaatctctaaaggaagagcaagacccttcctcctccagacttctagtctccctttagagcccgctgctgacagaacctgacaaagagccatccgatccagcagatacagtccaagcagaatcctgtgtcacaaagcaaaattgagagaggtgcgcttggagctgaaaaataatagcttagtaaactggcacagggaacattcacagtctttgttttgtttttagagaaggagtctctgtcgcccaggctggagtgcaatggcgtgatctcctgctcactgcaacctccacctcccgagttcaagcagttctcctgcctcagcctcctgaggagcttgtattacaggcaagcgccaccacgcctggccaatttttgtatttttagtagagatggggttttgccatgttgcccaggctggtcttgaactcctgacctaaagtgatccacccgacttggtctcccaaagtgctgggattacaggcgtgagccaccatgcctggcccatttacggttttttgacagaatgatcaaaagctttctcaacaagatattagagagaagagataacaaggtgggttagaaaaataaagtgaagccaggtgtggtggctgatgcctgtaatcccagcactttgggaggctgaggcaggcagatcacttgaggtcaggagtttgagaccagcctggccaacatggcgaaatcctgtctctactaaaaatacaaaaattagccaggcgtggtggcacgtgcctgtaatcccagcttcttgggaggctgagatgggagaatcacttgaaccctaggggcgggggttgcagtgaactcagatcacgccactacactccagcctgggcaacagagccagactccgtctcaaaaaaaaaaaaaaaagaaaagaaaagaaaaataaagtgaaggcaaaggtgagattagtttagtgataccaaacgtgggttaacttcagaaagcaccaggtcaagtgttgttttgttttgttgttcgatagcattccagaccctaaccccagaggattttttttagcaggtctagctagggaccagaaatccaaatttgttttggaaaagcttcccaggtatcagtggttgcctgggaaattaaggataaaaagaaagactgatgtttttctttttaccattttaaactgtttgaattattttttacatgactcatacaaatcaaaggtctggttagttactgtaatacaaaatgtgctgagttgtacagtacaaaatgtgttctctcaaatccttgctttatgtgggtcctcaaattaattaggtacagaaatttgttaagccaagatatacttctggaatgattgtctgagatatcagatttcagcctgattacatgatagagtaattaaaaactgaattaattatattttacattattagatttaatagaactttcagatttctggaaactaacactgtataaatatgtaaatatgtaatcccagtaacctttcttagagtaactgaatgtcatttgggtagtagacaaattctgtttatttcattgcccttttactttcagaaactaagttattaaagcacaaactgtatgcacaaatgaggggaaattgaaatgcaaacctcaatgaagagacatttttgtgctaaaattcctaattacataagttatttacaaaaacattcttgatttatggtgttccaaaatttcccttaaagcactgagttattaaaacttcccacagtatggccaggcatggtggctcatgcctataatcccagcactttgggaggccaaggcagaaggatcatttgagcttaggaggtcaaggctaccatgaactatgatcgtgccactgctctccagcctgggtaacagagcaaaaccttgtctctaaaaaataaaaataaggccgggtgcattggcttatgcttgtgatcccagcactttgggaggctgaggcgggtggatcacctgagatcaggagttcgagaccagtctgaccaatgtggtgaaaccccatctctactaaaattataaaaattagctgggcgtgatggtgtgcacctgtaatcccagctactcaggaggccgaggcaggagaatcgctggaacccaggaggcggaggttgcggtgagccaagattgcgccactgcactccagcctgggtgacagagcgagactccatctcaaaaaaataaataaataaataactttccacggtatgagtctatgttctatagaaatattgcatttgcacagaggtaaatgtaaagggatgtttgcagcaccattgtttataatagagaaaagttgtcagcaacctcagtatatgccaattatggtaaacacataattgaatactgtgcaaccattacatagattgtagatgatctgtatatacagcgtcaaaaggtgtttgtgataaacagagttaaaaaaaagcaagttatggaatagtgtgtacatctgtgttggttagaaaagcagaaaagtataagctcatagaaaaatatatggccaacgtgttggcttatgcccgtaatcccagcacttttggaggccaaggcaagcagatcacctgagccctggtgttcgagaccagcctgggcaacgtggcgaaaccctatctccaccaaaaaatatacgtattaatatataaagctagccaggtgtggtggtgcatgcctgtagtcccagctactcgggaggctgagatgggagagttacttgagcccgtgaaacagaggttgcagtgacccaaggtggagccattgcactcccagcctgggcgacagagcgagactgtgtctcaaaacaaaacaaaaaaatacttggtaggttaagaacaaagtgtttataggttttctgtgtgtgcctgaaggaaagaataaggtgaaagacttttactgtaagtcttagtggtttggctgatttttttatctacctaatacttgcttttttttctttccatagcattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttgagcgtgtcttttgtttgctctcatgtagatactaagtagcatggctcagagccaaaagacaagcgtgaagttaagagagttggctaagagagttggtggggcatgctcccttccattccttaaatgaagtaatctaaaatctcttagcaggttagttcaccataatatataagtagatgttgctttgagcttcttatatacatattcacagaaccattatataaatgttgttagacctcta

SEQ ID NO: 15069 - DNA, 676 bp, Homo sapiens
actgttccttccctcctcttacttagatgaattattcatactcttcctgttggaacccagccccacctcttaacactgaagctcatcctcttacctattcacagatagcatcggcagctccctccttcccttttccattagcatgtgatttctctcatcttaaaaaagaaattggcctcactctcctcttcagctgccactccatttctccactccctgtacagcaaaactcctctaactctgactgggcatgatcgctcacacctgtaatcccagcgctttaggaggccgaggtgagaggatgatttgaggccaggagtttgagacaagactggaaaacctaacaagaccttgtctctgtttaagtaaaagttttttaaaaaacaaaaatggccaggtgcggtggctcacacctgtaatcccagcactttgggaggctgaggcgggcagatcacgaggtcaggagatcgagaccatcctggctaacaaggtgaaatcccgtctctactaaaaataataaaaaaaattagccgggcctggtggcaggtgcctgtagtcccagctactctcgaggctgaggcaggagaatggcgtgaacctgggaggcggagcttgcagtgagccaagatcacgccacggcactccagcctgggcagcagagcgagactccgtctca

SEQ ID NO: 15070 - DNA, 514 bp, Homo sapiens
actgttccttccctcctcttacttagatgaattattcatactcttcctgttggaacccagccccacctcttaacactcaagctcatcctcttacctattcacagatagcatcggcagctccctccttcccttttccattagcatgtgatttctctcatcttaaaaaagaaattggcctcactctcctcttcagctgccactccatttctccactccctgtacagcaaaactcctctaactctgactgggcatgatcgctcacacctgtaatcccagcgctttaggaggccgaggtgagaggatcatttgaggccaggagtttgagacaagactggaaaacctaacaagaccttgtctctgtttaagtaaaagttttttaaaaaacaaaaatggccaggtgcggtggctcacacctgtaatcccagcactttgggaggctgaggcgggcagatcacgaggtcaggagatcgagaccatcctggctaacaaggtgaaatcccgtctctactaaaaa

SEQ ID NO: 15071 - DNA, 676 bp, Homo sapiens; identical to SEQ ID NO: 15069

SEQ ID NO: 15072 - DNA, 947 bp, Homo sapiens
agtttatatcagtttcacttcaattttttagggttgcataatttgccacaattttcatcagatattttggaatgatgtagcagaatacatcaagaaaatctccagttcttttgacaatttttgttagagctttttgattcttaccctcatggaaatacttgtgtataaatatagaaaatctcagattaaattattttcttggtagccttgcctgttcctattaagccacagaaaatattaataaggtgaatatgttaactttatttttcaaattattgttaatctcagcatactatgaagaacatgaatgtactgtacacacaaacaacttgatgtctcactaaatgaaagacacatgtgcattagatccatctacctttcaggcacagtcatggggtttttaactccacaacattaactggaattgtggaatacagataagatcataattgcaaagatgtgatattccctgaagaattttttatctatgatcaaaatgcaaaaaatttaatgtgttatggtaatgttccttattatccatgattaagtcacaccaaaatggcacaaagaccaggaaaccagccaagcattcactggaggcattactcagtgtctgagagattcagttgatttatatgaattaaggaatattttactatctagtatgtatcatttaaaataaaacaaaccttctaaagatgataattgtaaacatttgaattgtgtttttaattggaaaagtaatgagcttgtactgttaagctgtttcttattttatgttctatgctttcacaatttacatttacttacttgtaaattgtgttatctgaagaattttttccatatctgatgtctgcataactccggaatattgttagacatttaataggaacctaattataaaacaaatttatttactatgtatgccattaaaaacattacaatta

SEQ ID NO: 15073 - DNA, 947 bp, Homo sapiens; identical to SEQ ID NO: 15072

SEQ ID NO: 15074 - DNA, 949 bp, Homo sapiens
agtttatatcagtttcacttcaattttttagggttgcataatttgccacaattttcatcagatattttggaatgatgtagcagaatacatcaagaaaatctccagttcttttgacaatttttgttagagctttttgattcttaccctcatggaaatacttgtgtataaatatagaaaatctcagtattaaattattttcttggtagccttgcctgttcctattaagccacagaaaatattaataaggtgaatatgttaactttatttttcaaattattgtaatctcagcatactatgaagaacatgaatgtagcggaacacactatacaacttgatgtctcactaaaggaaagacacatgtgcattagatccatctacctttcaggcacagtcatggggtttttaactccacaacattaactggaattgtggaatacagataagatcataattgcaaagatgtgatattccctgaagaattttttatctatgatcaaaatgcaaaaaatttaatgtgttatggtaatgttccttattatccatgattaagtcacaccaaaatggcacaaagaccaggaaaccagccaagcattcactggaggcattactcagtgtctgagagattcagttgatttatatgaattaaggaatattttactatctagtatgtatcatttaaaataaaacaaaccttctaaagatgataattgtaaacatttgaattgtgtttttaattggaaaagtaatgagcttgtactgttaagctgtttcttattttatgttctatgctttcacaatttacatttacttacttgtaaattgtgttatctgaagaattttttccatatctgatgtctgcataactccggaatattgttagacatttaataggaacctaattataaaacaaatttatttactatgtatgccattaaaaacattacaatta

SEQ ID NO: 15075 - DNA, 4152 bp, Homo sapiens
aaataaaaaccactcctaggaagaaactgcatcaactaacgagcaaaatcaccagctaacatcataatgacaggttcaaattcacacataacaatattaactttaaatataaatggacaaaattctgcaattaaaagacacagactggcaagttggataaagagtcaagacccatcagtgtgctgtattcaggaaacccatctcacgtgcagagacacacataggctcaaaataaaaggatggagaaagatctaccaagccaatggaaaacaaaaaaaggcaggggttgcaatcctagtctctgataaaacagattttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagaacaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaataatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaatctagcagaaggcaagaaataactaaaatcagagcagaactgaaggaaatagagacacaaaaaaaccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcagtatacgcaaatcaataaatgtaatccagcatataaacagagccaaagacaaaaaccacatgattatctcaatagttgcagaaaaagcctttgacaaaattcaacaacgcttcatgctaaaaactctcaatgaattaggtgttgatgggacgtatttcaaaataataagagctatctatgacaaacccacagccaatatcatactggatgggcaaaaactggaagcattccctttgaaaactggcacaagacagggatgccctctctcaccactcctattcaacatagtgttggaagttctggccagggcaataaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtaaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagaaccctcagaaataatgccgcatatctacaactatctgatctttgacaaacctgagaaaaacaggcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggttgtggagaaataggaacacttttacactgttggtgggactgtaaactagttcaaccattgtggaagtcattgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagtctggattaagaaaatgtggcacatatacaccatggaatactatgcagccataaataatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgttgtggggtcgggggaggggggagggatagcattgggagatatacctaatgatagatgacacgttagtgggtgcagcgcaccagcatgggcacatgtatacatatgtaactaacctgcacaatgtgcacatgtaccctaaaacttaaagtataataaaaaataaaaaataaaaaaataataaaaaaataaaaaaaaaaagaaataaa

SEQ ID NO: 15076 - DNA, 4152 bp, Homo sapiens
aaataaaaaccactcctaggaagaaactgcatcaactaacgagcaaaatcaccagctaacatcataatgacaggttcaaattcacacataacaatattaactttaaatataaatggacaaaattctgcaattaaaagacacagactggcaagttggataaagagtcaagacccatcagtgtgctgtattcaggaaacccatctcacgtgcagagacacacataggctcaaaataaaaggatggagaaagatctaccaagccaatggaaaacaaaaaaaggcaggggttgcaatcctagtctctgataaaacagattttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagaacaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaataatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaatctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcagtatacgcaaatcaataaatgtaatccagcatataaacagagccaaagacaaaaaccacatgattatctcaatagttgcagaaaaagcctttgacaaaattcaacaacgcttcatgctaaaaactctcaatgaattaggtgttgatgggacgtatttcaaaataataagagctatctatgacaaacccacagccaatatcatactggatgggcaaaaactggaagcattccctttgaaaactggcacaagacagggatgccctctctcaccactcctattcaacatagtgttggaagttctggccagggcaataaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtaaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagaaccctcagaaataatgccgcatatctacaactatctgatctttgacaaacctgagaaaaacaggcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggttgtggagaaataggaacacttttacactgttggtgggactgtaaactagttcaaccattgtggaagtcattgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagtctggattaagaaaatgtggcacatatacaccatggaatactatgcagccataaataatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgttgtggggtcgggggaggggggagggatagcattgggagatatacctaatgatagatgacacgttagtgggtgcagcgcaccagcatggcacatgtatacatatgtaactaacctgcacaatgtgcacatgtaccctaaaacttaaagtataataaaaaataaaaaataaaaaaataataaaaaaataaaaaaaaaaagaaataaaa

SEQ ID NO: 15077 - DNA, 2788 bp, Homo sapiens
tacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcagtatacgcaaatcaataaatgtaatccagcatataaacagagccaaagacaaaaaccacatgattatctcaatagttgcagaaaaagcctttgacaaaattcaacaacgcttcatgctaaaaactctcaatgaattaggtgttgatgggacgtatttcaaaataataagagctatctatgacaaacccacagccaatatcatactggatgggcaaaaactggaagcattccctttgaaaactggcacaagacagggatgccctctctcaccactcctattcaacatagtgttggaagttctggccagggcaataaggcaggagaaggaaataaagggtattcaattaggaaaagaggaagtcaaattgtccctgtttgcagacgacatgattgttatctagaaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtaaactcccattcacaattgcttcaaagagaataaatacctaggaatccaacttacaagggatgtgaaggacctcttcaaggagaactacaaaccactgctcaaggaaataaaagaggacacaaacaaatggaagaacattccatgctcatgggtaggaaaaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactgcaaggctacagaaaccaaaacagcatggtactggtaccaaaacagggatatagatcaatggaacagaacagaaccctcagaaataatgccgcatatctacaactatctgatctttgacaaacctgagaaaaacaggcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggttgtggagaaataggaacacttttacactgttggtgggactgtaaactagttcaaccattgtggaagtcattgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagtctggattaagaaaatgtggcacatatacaccatggaatactatgcagccataaataatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgttgtggggtcggggaggggggagggatagcattgggagatatacctaatgatagatgacacgttagtgggtgcagcgcaccagcatgtgcacatgtatacatatgttacttacctgcacaatgtgcacatggtaccctaaaacttaaagtataataaaaaataaaaaataaaaaaataataaaaaaataaaaaaaaaaa

SEQ ID NO: 15078 - DNA, 6074 bp, Homo sapiens
gattctccagaacttagggcctagagatagcaaacccgaattccaaaatgtctctgctacttatcaaccgtatgtggccttgggtaagtactgaacctcttttggcttcagcttcatcatttatgtgggaattcagctccacatagattctctgatctcctgtgattcaccatgctccaggtaagggactgggccacagagatgagcaggagaaggccttgccttcgggtctgccttttaaaggcaagtgagcaggtccttactcctaatggtcgctgtgatgactgctgcacaagaccactggcctcgccctcactgaccccatgggggagtcaggagaatcagatgcagaagcttgcagaatgccagagcttcacatatggaggctattactgtcgtcattataaccataaccctctgcaggtcagcccggtaataagaggacagaaaaaatactgggggctggtctaatttctgagttgacaaatgctaatgcaacttgatagttactatttaattcccaagagtttgagagattttaagtatattttacttaaatgttggattactgcaacccccaaattatttcaggtgcatgtattaaattaggcttttcatctcgcactgtaggtggctgagtttgtacagtctcttctgggctgtgaagagcatgccaagtgctttaagaaagaggtaagagatgcaaaaattatatatatatatatgtatatatatatatatgtgtgtgtatatatatatatgtatatatatatatgtatgtatttctatacttctagacccagaagtgttttgttttcatttacttaagtgtaaataagtacaatttgggggcagcaagacaaaggagatccagcaggaatagagcccaattatgcagtgtgagaccaagctgggtcagtctccgccttcagtcctcttacattttgctaggttttgttgcagaatgccatggtgcttggtgcatacagcatgctcagtacgtatactatttgctggaagagtaaatgaaaaagataattaattaatacctatcagtgtcatgaggcctctccattggtggcttgaagccatttgcgggaaggcaggaatcctcccttgggattgcacctgggaaagattggggatttgtctactccaaagtcagcatgggaccctcctatctatccctgccctgcatttgcttccagagcagccccaaatccttctacggggtttctatctcctgtcccctcttggttgggaatgtactgaactgcttcgcatatttcctggaattagtatccatagctataggggccccggaagagactggaccagctacagaatgatgcacatactaatcccagtgcttgtgtatcaggggcttgccatgtgccaggcatggtgctaagcattttacaaccattatcctttgatccttgtgacaacactacaatggcagcttaccgatgaagaagctcaggcccaggaaggtgaggcagagcaagaaaagggcaagaaaagtcggattccagctcatatccatctgagagctcagagcctccatcgctgctctagaactttccaagaaaaccatcctcatagaaactgaaaggcagcacatacctctccctctctcaggttcagagcatgcatgagttaaggaagtgctgagttttgggttctggacccctccgagcacagtagaggaactcagcatcaaggtcagatagcctcagtctgggtagctgctacctgtggggttcgcctggctctgcctgagctcagcatggcttgggcatagttggccacgttcacacatacagtctactctgcaggtagcgatgatcaaggcttgctttgtcctcaagtctgtccacgtagggtaagagggagtggctttttgcaggttgaattgcttatatttggcactcactgaccagtactgtcactttaggcagattgctgaacccctcttatccctcctctctgaaacacagatttacgagaggggcccttaaagattagggtgagcatgtttgaagcaccgagccctgttcttgtcccaaagtaggggcttaataaaggcagcagtatatagcagagggtctcctctgggctccaacaagctctgccagaaatcccaactttgccccttagaagctgcatgagcttgggcaagtcattaagcttgcaattccaggtttcctcacctatattacagggttatcaggaggatcaaacccatataatagattactgtagctccataaatgttagctgttgttgtcaccatcacgaccttattcttaggacaatggggtatttggacagcaatttttgcctgaaaatgctggagcttagccaggtcagggtatggatgtaggctcattctcctctgccttggggaaaatgccttttccgagggaaaaagtgtttcctcctctagatggatgagtccttatcagacaatatatcataaatgcacaggaaggttttaaaaacttttttaaatattataacttcaaaacgctacccttggggtcccagggtaattctatcagtgagacattgacactacaggatttttcttcctcttcttcttcgtcgtcttcttcttcttcttgttcttcttcttcttcttcttcttcttctttttcttcttcttcttcttcttcttcttcttcttcttcttcttcttcttcttcttcttcttcttcttctccttctccttctccttctcctcctcctcctcctctttctccttctcctcctcctccttctccttccttctttttccttcttcttcccttctttttttttttttgaggtggagtctctatctgttgcccaggctggaatgcattgggatgatcttgtctcactgcaacctctgcctcccaagttcaagcaattctcctgcctgagtagctgggactacaggcgcatgccactacgcctggctaatttttgtattttcagtagagatggagcaggggcggggggtctcaccatgttggccaggctggtctcaaactcgtgacctcaattgatctgcccacctcggcctcccaaagtgctgggattacagacatgagccaccatgactggctggggtttgtattattaaatttgaaaaggtttagaaccacagttctaagttcgtggaagaatgtttccatagaaaacccttccattcctgccttcttggttctggagccaggaatcatctgagccaggctgtgtcaatcagagacgctgcagtagtccctggagttgtgctgaggtcactggggcatccagaagctggggaaagcagcctacacggtggccactgccatcctgtgagtctcggggaagctattactttcatgctgtaatatctttttaatttaaaaatatttaattgtcaaaacaagattgaatacattcaaagtgtataatgtgatgatttgatatacatatacaatgcgtgatgattaccaaagtcaaattcactctttccattaccacccatgccatacatcagagccccagatcttgttcatctggagccaggaatcattctgtgcaagttttgaaatgtatttttaaagtttaataaataaaacatttattttatgtgtatttttgcttataatggtatgtattctttaaaaaatttaaatacaggaaagttgaaaggattaaataaaaactaaccactattctacatccaaagataatttcagttaacatttggtgtaaagacttcaaaatattttaaatatgcatatgtatacatgcagccatgcatgtttaattgtacaaagtaaaactgaaatctttctctatcatataccatgttctgttgtttactgatctataaaaaaaaaattcctaaatcattaaatgtttcaagagagttgattttgggtgactgcatagtagcccactctgactatagtattatttacttctgatattattgggaacagtgggttgctttcaagatttcagtattataaataatactagcatatacacattgcacattattctcttgggaaaaattcctggagatttacttggttttaaggctcttgatacaaattcaagccaacctttttaaaagacaacaatagaaatgtagcctgggaacagttcgtgtatattgaattcgtatttaacagcatgagcatcttttcaatttaacttcaaagttctagaagaaagaattggagtggagcaatggttgtaactaagccgagtgagagctaccgtcattctctctcactggtgagctcaacacggaggctatgacgggttccacatcacactcagaaccaaagtgttactggtgagtaaacaggcttccgtggcaaaacatttttatttgtgtctatttatgtatttgcagcagatcgatggcaaagccttcctgcttctgacacagacggacattgtcaaagtgatgaagatcaaactgggcccagcactgaagatttacaactctatcctgatgttcaggcattcccaggaactccctgaagaagatattgcctcaggccaagaagtcaggggatgaatgggctccctgaacttcctctggcaccaagacctgcgctctttcagcaataaaagtggagcacattaatttgatgtgaatgtccccatggccgtatccacactgaatctggactttttaaagtgtctgtgatttgtttacatgtttagaggattttgatgactggtccagtgccaatgactcagaggcttaggcccatctgtgggtttggtttacgaacattgttatctttggtgggatccgctcagctctgatttgtttgcaagacagaccaaagaagcccacacatccacctttattcttctccgtcaccagaaaagaaaccattttccatcttacaagcataacactctcaagtggtgaaatattagaaaagcagtgttcatgaatacatcgttaatgtttttaccagagcaacatcgagcttggctcagatctgccatggagcacagctagtctaagagctagaggcctggtgctttcaaaagacttcatgtgagatttttgtgtactttactcaggaaagtgtgaatctctaaaaaataataataataagcacatgttttcatgattcattaattctcctttttgttccattaaccatttcttggttgtgctcccaagctttcctggagcctccacaaaggagagtagccaggagtaatgagaggacggtcaggtgggcacttccaaaagctggagagacccttctgaggaccctccaccatcagcggggcctcaggggaccctgtcctaacactggtgtggctgctgggccagacgctcacctgcacagaactcctccctgctcccactctgaagggcgtttcagaattgactcatttccactgcagtctgccagaacccctgtaataaggagctgtgttatattacatctggggctgtgtgcatctttacaaatggagacacactattcaaagggaagatctctaaagtagggagcgtggtacttattctttgtttgaaacattccgatttgttgtcaggccttatttgttttttgtaagtgattgtatcggaggcttaagttgtgtggaatcagtcccacagtgttgaaagacaagtacctcttttctgacacttcttactacttttacaggtagtaacagctacaaatactctcccagaagtggagggacaccatttgtgggtggggagaaagagggagaggttctatgtccacttgcttcattaagaatgttaaggtttaagaaagttgattctgcttggagaatttctcaagctttacatttttttttcactgaagaaaataaacaaactctaagaggtgtgcatatataacatttctttagatctttacctaaaaggaattttaatatattattggttgatgtaaattttgtttctgtggagttttgtttgttttgctttttgtagactgccatgtgcaagtaaaattcctgcttctgccatgttaaaattttaatatattttaaatgataataaacagagaaaacaaaattta

SEQ ID NO: 15079 - DNA, 476 bp, Homo sapiens
ccttgtctctatttctattatttcctcctatgacactatgaaaaagtgagcccagcagaagaactggggcaatgttgccccccaggggcatttggcaatatctgggcatatttttggttgttacaactcagaaggggactttcctactggcacctagtgagtagagggcagggataccgttaaacatcccaccccacccaggacagccctcacagcaaagaattacctggcccgaggtgtcagtattgaggttgaggaacttggctttacagcattttcctgcgctcatctttgattcctgccctgcctagccctgaggctcagcatgagtctgtacagaccctgctggaccatttctctagcttcctgcagcgctgtggtccttggccctcagtgcacactggaaccaactgggaagctctaaaaatatctacccagtgcttggacccaatccaactccattaatttatcatctg

SEQ ID NO: 15080 - DNA, 6131 bp, Homo sapiens
gcagcaggccaagggggaggtgcgagcgtggacctgggacgggtctgggcggctctcggtggttggcacgggttcgcacacccattcaagcggcaggacgcacttgtcttagcagttctcgctgaccgcgctagctggtgagtgtcccttctgtgtgtgggtcctagagctcgcggtctggtctggtctggtccccagactgacgcctggtcggtccccctcttgtcttacagcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaaggtgagcggtgggcgggtgccgacgcgactcgaggggccgggaaggtacagaaaaggagcccaaagactcaaaagtttaaaaaaactgctcaactcaaacagctgcaagtgaccaacctggctgggacttaaaccagatctgtttgattctagaacgtactgcactacctttttaattaatagaatagaataaaatagaatggatttcttctaccagattttgtatttcatcactggcaagttctgccttccacaaaactcttggacacaatacaattcagccaagttgtttgcacctttataacaaggatagcttttcctccagtttccaacaacatgtttcttatttcacaagcatttaggtaatctctaagaatatcacggcttttctctacagctctcctcttctgagctctcaccagaatcacctttatggtccattcatggcaagccaggctttttccagcatgtacctccaaatttttccagcctctattcattacccagttgcaaagctgcttccacatttttaggtatttgttatatagcaacaacccacctgttgttaccaatttctgttttagtctgttcaggttgtaggacaaaatatcttagactgggtaatttatgaacaatatgaatttagcactcccagttctagagactgggaagtccaagatcaaggtactagcaggtttggtgtctggtgaggatctgtttgttcttcgtagatggcaccttctatgtatcctcacatggcagaaggggcaaggcagctccctgcaacctcttttataatgacactaacgtcattcagtaggatacagcctgcattgagcctaatcacttccccaaagttcccatctcttaatgctatcatactggatattggatattaggttccaacatgaatttggagtggagggtgggaacaccaagattcagaccatagctattatgttgctcaaagataacaacaaaaaattaatatttggatattatggttgtaagttatagtcataaagcacttaaaacattcaaaattttggagggttataaaatgttgagaaaactcagattcacataaactagttaagacgaattgtgtactactttccagaccactcaccttgcaatctcaggatgttctttattcaattaaacagtgatgacagaaataaacttacttcttagtcaggaaaattgagttaacctgcatacatggtaacaggcaggtaattcttcgagctgggttttttaaatgacggtttttgttttgttttgttttgttttgtttttttgagacagtccactctgttgcccaggctggagtgcagtgatgcaatctcggctcactgcaacctccgcctcctgggttcaagcgattctcatgccccagcctcccgtcttcaccacggggaaatataggtaatgtatttataattgttatatcaccttgatggaatgactcattcaaaatatataatgtccttcttagtttcttattataatttccgttttaaagcttattttgtctgatatagccatctctacttctttctgttactatttgcaggtaatggctttttccactcacaatcaatcttgtctttcaatctcatgcaagtttcttgtggacagaatatagctagatcatgtttttttaaaaatccattatgccggtacctgccttttaattgaagtgcaatgcatttacatttaaagtcattatcaataaggaatgatacacttctgccttaattttttttctgtttgttttacgtcttttatgtttttcagtcatgccattaatgtcttctctctgtttagttttcttttagtgtactattttgattcacatcttgcttccttttttgaatattttttagtcattttcttagtgtttaacctgtggattataagtaatatcttaaatttataagattctagttggaagtaaaacgaatttaactttgaaagtatacaagaattctgcttgtaatataacttcgtttctccccttttatattgttattgttacaaattacatctttataaattgcataccaattaacatagaattataaatttttaaaatgcattttcttttaaatcatatagaaaaaaggattagttacaatactaaaatgcaataatacttgcatttatatttgtctaagtagttaatttaaccagcttttaaaaatttatttgtatggcttcagttttctgtctagtatgtttttatttctgcctgaaggactccatttagcattttttgttgggtaagtaggtctactagcaataaactttgtcagcttttgtttatctggaaataccttagttttttcttcatttttgaagaatagttttggcagattcagttggtagttttttgttgttgttgttgtttgttttgttttaggcactttaaatatgatgttccattgccttctgccttctatggtttctgacaagaaatcagtggttaatgttattgaagatctcttttgtatggcaggtcacttctctcttgctacttccagaaatctcttcttgcctttgtcttttaacagtttgattacagtgtgttttggtgtgtacctctttgagtgtattctacttagagtttattgatctgcttggatgcatagattagtgtcttttatcaaatttgggaaggttttgtccatcatttcttttaacagtcttcaccaccccgctggaaggatccgcgcgggccttcaagaggaccgtctccacccgtgtgaagaacggatgctccattggtttaagtgatcagaaaactcatttggaggaattatgtgctttctctgggaatccgacataggaaactatgagaaggcacacacagttagttaaagcaggtctttgtatttgctcttattagaaagtttcaaccttttgtagatgaactcaagtgattattttggaagacagagcgttcttaggttggactgagttaactggatattcaccttgcttcagttagtgatgtggaacacccaggacaggaaaaagagaaattactacaatttaatatatattgggataaaagagctcaccttgatttatcactctgaacaaaaggggtcttccctccttggaatcccacactattaagggaatttctgttgagagtatcaattccagacagtgttgctccaatctgctcatcacagactgtcttggctgcagctctatgctgttggtgtgcatgggctgcacttggaaggtaaaacctttagggtggccagttctcatcatacagggctccctttgctaaccccttgcaaccacagacacacaagtctctgagtctctcagggaactttttggagctttggccaaaactatcattgcagtcatctttgacagcaccagcagaatcaaacttctctttggggtggctcaaaacttctcacctgcttttctgcttttgacaaaaaggcaacaattaaaacaaccaagcatcactcgtcctgaggacttggcccactgtcttcttgttctgagaatcaagaaagcaagatatggaagggataaacaccatgaacaggcgtcaatagcctgtgattataaaatgaagggcactataacttttaaaagttattctgtttttcatatgggtaatacatgcatgtgatatgaaattcaaaaggcactgaaaggaatgtagtgaaaatcttccttccacctcatttcccagatagttcctttccccaggtcttcaccacgggtggctcgtgttttcatcacagaggagagattagtgccctcatatcccacccacctctcctgtgcggtggtagtttttgacccagcccacccacccctaatctccctcgctatcataacctggggtaaaaggaaccgaaaattgtgttttttctctctatccaagctctacaggcgttagttggtgttgccttcatataaaaaaaaatgaggaattggggacaaaaaaaaaaaccctagggggtgttttaataacgaattaagagcggggataaagggttataggccacttttgagaaagaggtaaaaggccggcttttttttttctcacacccggtcaagaaataaagtgtggggggaccggtcactagggaaataacgccaacaaggtgaaatattttgcccaaggcagaaaagaatcctggttgttttaaaaaaaaaaggaacttcccgcccctgagtgaatgcctttggacccggttcagaacacccggccagtgagggtcacaagcaaattaccggtatttgggaaagaatatctttggggaaattaggcctagttaagggacctaggttttcacccctgtgtactacccttatcaaattgcttcaagaaaacttgggcccaggcgagtctgggctctagacgccctgggcgcctgttaatgcctagccagttggtaagccaggtgggcaaagcatggttgcgcctggcctatagcgaaccgtacggcgtccgggaggctctatagtacgtctgcgtgagcagggcaagagctgcctcagcgtgggccagctggcactcgaccccagcctggtgcccaccttccagctgaccctcgtgttgcgcctggactcgcgactgtggcccaagatccaggggctgtttagctccgccaactgtcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaacagttggttgagtctctcat

SEQ ID NO: 15081 - DNA, 8645 bp, Homo sapiens
tttcaatataaatgtgtaattttaatatttaatttaaaataaaaccaaggctggattggattgggaaagaacgtttgatttgcagaagaatataggaatttttttaatcacgacattacaagtcatttgtgaaaacagccttcctcctgccaccggctccctatacaacctgcttaggaaatatggaggtgaatcatcccccttacctcttccctaccagggcttggttctccccaaaatccaaaggagaaataaatgtcttccgttgcctcttcccatttttacagtcagcttctaaccccttgcaaagccctgaatcagagccaagcacctcagaaaatgagggtcccttggttctcttattgaagttgggcacatgtggtcagagaagccccaaggaaggccacagggactgacacctttacttttggaatttgtgcagccagttgtcagggctcccaggtgcaaccaccttataaccatatccacagtcacagaggagggagaggaggaaggatgaaaaccctgagcaggaccagacccccgccactttatcatgaccctaccaaagtccctctcccaggggtcattggcagagaaaccccaacagctctctcaatcaatcactggggcagcagggaaggctgagggccctggctggggaaaagctggtctttggagaggtatgaatgtgcagatataaaaagcaagaagagcatccttatctccttgccttggctaaggcactgacaggaaaaatgcaaggtaggaatggcaaagaggggaaaggaagaagacaaaaatataggaactggaggggtatggggactaccacatgggccccatacttgtgcaaagaaatgggtagagccatgcctgcatgtctgttacccataacattcccctcaccctgctccagagtggaaggaaaatgagttgcaggaatccagggagcacaataacatagggtatttccctgagccttagggttaagggctaaagaataaagctttatacacatggcaatttctatcccttcctatccttctcagtccccatcagcctaatgctgaccatccttccactataagagagatgagggaggtgtcggcacttgaggaaaaggctcagttggcttgaaatgtccactcctacagtggaaagtccatctatcagcttattgctgatgattttttttttttatcaccatcactctgacccctccctgtcttaggtctgaataattgggtcacccataggaatgcagaacccagggtgggcagagcagagcagcacttgctgggataggcctcgagcctggtttctgagtccttgaggaccacgagctaacaggagctggtctgtaggttgctctccgtaagcagtgatgcaatggacgagggatcgtagacactgtcgaattcctcatctgagctcagcccttcgtttttgagagctgactcagcagctgagcgggaagctttgcgcctgactcagagagaagaataatggttggggaggggaaaatagaaatattaagacagccaccctttttgtacaaaggaaaccccaattcttctaaggcctaaagtttattcacaaaatccccaactaatcagatttggggaggtacaggatggtggctgagatactaataaataaatatactggcttccaaccagaaacaagtgactacacagtaccatgttagagattctcctccttatccagcacaggagagaccattccctccctgctctagtgtccctatggagcaagggcaaaagggtagcccataccaggagtccttctccagagacttgatccgggcctggagctgttcattgacctcatgctgctcctccacctcacgctgggccttcttcctcaggccgtccagtcgctcaatttcctcttctgcttcatccacctgacgcttcaaagccttcaccctcaggcttagctgggcaggataccaagtccacacatctgaatagcatctactaccatggcctgggaccctcccccataacaatcttgacaaggtataattgccgctggaaaaatgtggccttgggcaagttccttaacctcacatggttgtcttagggattaaatgtattaacacatgtgtaatacttacagaacctagcacatcataagcactcaatatatacgcttaccatgacttctctagtctagtcttttcaatctaatctctgtccttatacaaggaaagtctaagtttggaggacctataggagataagggcctcccttggctttcaggaaaacatataatatatacctgccccaggttgcttggctccagggtgccatgtcctcacctggtctttctggtcattgacatgctgccgctcgtcttcaatctggatggatagttctttaactttccgctccagttttcgattggtagactgcagaactgtcttctccctaaggtgaggtagaagaatgtctatgagtgtccccatttctaagggaatcctaacttggccccctactgtccccaaggactcctctcagccatgagctccaccattagactgggcaggatccagggcagattcaaagaatgagggagagtgacgtcattcacatttcagaatttctgcaacactctttgctctctatcaggagaaagtgttccctaaagatcaggccaggctggccatatctgaggtggaagatggagggagccacagaggagaaaagccaagagggagggaggaagaaaaggagggaggaagggaggaaggataggcttatgtcacctctcttcagcctgtagccgctcctgcaacaactgattctgggactcaagctgagagaggctggcactaggcttctggaagccttctgagctggccaaccgggtcttcaggtccttgttctgagagggacaggaagcctccacagttagcactccactggccattttactcacctcctggggtccatccctaagaatcctcccctcccccatcacctgtctctccaaggagattttgtcacactccaggtcctgccgagcagacctttcctgcatgagctctgtcctcagctgatccacctagtggggatgggtgagaggaccagacttggggagggctaaggatgaaccagcaagctgaacaaagtgaggctgagtcatgggaggatggtctctgaaccctgaatccaaaaattcccaggcaactaaaaaatcacagcctattcaaatgggaggggccagagaatgcaaacagagcctccttcgtccctccaggaactagtatcccttgtaaaccaaagaagccccaattcaggtcagagaacagcccaggccaccaggatcccttcctccatgcaaatcattggcttctttccacccaaggaaactggccaacctttcccaaagcagacaaaaccctgaaggagacccagccacgcacagattcggcagccagatgatgaaagatgggagggtagagttgtttttgagagaaccaagaggtgatgcagtcaggggtaaacagagatgaggggtgggggcggttacctggtcccggccacgattcacccgatctgttagcagctccacggtgttcttctcctcatctaactctgtttccagccgtgagactttttcctaggacagaagaacaagtaattctgtcccaaatgctggacaccagaatgccaaactcagaccaggagcctctcaaactccagcattaacagacttttctctcttgcacatcccagtaaccttttggtacttgcctggacccagagccactatggagccagcgccctctactgaccagatgtggcatcatgggcaggtcggggccatgctctggtgacggccctttgacagaaaggcaaaccccagaatctactcttcattggaaaaccttatttctctaatgggaaaagagagagaaacccaagtacctgggccaaggctgaggtgaagagactcagaaactgaggtactggaggcagtaccacgtagaggctaagagtatgtacatgggaccagactgtccagtctgaaaatcagatttaccacttcctggcagtagaccatggacaagttcatctctctgtgcctcagtttccttcatctgtaaaatggagaaaacaagactacctaccccacagagttattctgaggattaagtcttaagtgcctatcacacagcacaatatgtttgctgctgctattattattatcaaatatagcaaactgaagaatactgttcactctaaaggggaaacccactgctcagctccagccaactgttgccatgcagactcaggacaagacactcagtattaccatatctgccaaatacaaaagaaactagaaatccaaatttttaggtgacctctataaatttctaaacattggcaattgattcaaagttgttgaaaatactgcagccaaacaaaactcatcaactgtgggctgtcggttttgaccgctagtacagaaagaggcttggaagtcccaccctttttccacaggtcacacctcagtgccctcacctcgagacccttcagctgccgggccctgtcgtcctgggaacgcttcttgttctctgcctcttgctccagcccctgcagtcgctgggccagtagctctttgtccagccgggctgtgtcccgctcagcctgggatgcctgcagggcctgccgcagcctctggatctgggcagggggtaaaaatgccacagctcagtgtagtgagaaggtgagggttgaggggcaggagcagtccagcccagtgggcagaaacatttcatcactgtcactctttagaattaccagtggcatgatgacaataaaaagcaaactgacttttcatccattttctttttttttcattttttagatggagtctcgctctgtcgcccaggctggagtacagtggtgcgatctcagcttacagcaatctccacctcccaggttcaagtgattctcctgcctcggcctcccgagtagctgggactacaggcatgtgccaccacgcttggctaattttttgtatttttagtagagacggggtttcaccgtgttagccaagatggtctcaatctcctgacctcgtgatctgcccgccacagcctcccaaagtgctgggattacaggcaagagccactgcacctgccctcattaatttcctttattgtttttgtttttgttttttgagatggagtcttgctctgtcgcccaggctggaatgcagtggcacaatcgcggctcactgcaacctccacctcccaggttcaagcaattctcctgcctcagcctcctgagtagctgggactacaggcatgcaccaccacgctcagctaatttttgtatttttagtaaagacaaggtttcaccatgttggccaggctggtcttgaacacctgacctcatgatctgcccgcctcagcctcccaacgtgctgggattacaggcgtgagccaccgtcctcagcttctttattgtttttaaagtctctacacaacttggaatcacctgaggagtttttttaaattctgatcctggatcccatccccagagatgatgactgaagtggtatgggatacagcctgggtgtggggatttttaaaaatctcctcaggtggctctaagctacagaatttgaaaatcactgctctacagacaatatattcctccaccctgcaagtcattagacctaaacctgggccccagggacccttggccacaggttcagttaagaggcaaggaccgggctgggcgcagtggctcatgcctgttatcctagcattttgggaggccgaggagggcggatcacgaggtcaggagattgagaccatcctggctaacacggtgaaaccccgtctctactgaaaatataaaaaattagccaggcgtggtggcaggcacctgtagtcccagctacttgtgaggctgaggcaggagaatggtgtgaaccccggaggcagagcttgcagtgagccaagatcgcgccactgaactccagcctgggcgacagagtgagactctgtctcggacaaaaaaaaaaaaaaaaaaaaagaggcaaggaccttcaaacccaaggatattagacttctacctcatcctgaagtcggctcagtcctccagaggtcttctcagcctcactggcccaatccttggcctggcgctgggcatctgccacctcccgccgggccttttccttataatcctccagctgggcctggagctgctgcagggcttgcttagagtcctccccgatcttctccaactgaaacacagagaaaagggtcttcagcactgtacataaatgaccctctccaggcccagactcccaagactctcccctaagggtctccttcctgacaaggcagccctctcttgctctttcctgggcctaggttcctagtatagctaatagttatatacagatgtctgggttcaaatcctggctctaccacttactggtgaccatgtgcaagttacttatctctctgggtctcagtcccccatctgtaaaatgggattaaaaatagtaactatatcacaaggtgttgtgagaattacattagttaattatgtgaagttctgtacttacaacagtgcctgatacaaagtaagccttaaatgaccatttcagcaaacccaaggtgccaatgattatacggcgtaccactaagaaaaatatgccaattaaactataacataccataaggtataagacacaactctatttcagaaatgataaaatgtgcatttttcattgacaaatgataagatgtgcatttttcattgacaaatgataagatgtgcatttttcattgacaaatgataagatgtgcatttttcattgacaaatgataaaatgtgcactttagaattgatgtaacatattacgtgtttgctcttgctttacaaaaagattgggaggagaaccttagcagcaaaagcaatttatttccttttcttttttctttcttttctccttcccctcacccaaatttaaaattctaccaatgaagatttttttttttgacaggctcttgctgtagcgcagtggggcagtcacagctcactgcagcctcaacctcctgggctcaagcaatcctacgtcagccttccgagtagctgggaatacagatgtctgggttcaaatcctggctctaccactaattagcaaccataggcaagttacttatcttctctgggtctcaattccccatctataaagagaaactgaggaacaagccaccacagcaggctaattttatttttaagtagagacagagtcttattatgttgcccaagctggccattgaagattcttgtatttaggttttgtagactcccaagggagaatcccaggagatgttctccaagaatgaagaccataaaggaataggatgtaagggaaagagcaaaaacatggaggggaggtaggaaggatgccccttccagaagatttggtcttggtcttcctaacaatgaacttgaggaaagcaaacatcacacattctttttttttttttcttaagacagagtcttgctctgtcacccaggctgaagtgcagtggcatgatctcgcctcactgcaacctccaccttccgggtgcaagtgactctcctgcatcaccctcctgagtagctgggactacaggcatgagccaccaagcccggctaattttttgtatttttagtagagacagagttttgctatgttggccaggctggtctcaaactcctgacctcgggtatctgcctacctcagcctctcaaagtgctggaattacaggagtgagtcaccgcacctggccataatcatcacacattctgactaacccctctcccccaagcccctgtcctctcaggccagcttctggatgagctgggcctcttcctaaaggcccagaataccccatgccccacctccttgttcagtcggtccacagtcctgtccagcaaacgcttctgctcctccagctcagccttgcctcgccggagcacctcccgctgcttcccttcctcctccagggcccggttcagtgtctgctgctcctgccccaggcgggccagcccccgctgagcctcctctaggcgtgcctccagtgcccgcttggctgctgccagactcccctcctcttcctgggacgcattcagggcctcctccagctgctgtttctctgcctgggaggtagggaagcagggttggactgagaaaaggtaaaacttgggttcaagtcatttggaggtgggtagctgggcaggagaaaggaggtatttatgaaaatgatgtgcaatgaaaacaggctcctagcaaagaaatcaggacacatagagcaagcaaagggtgagaaataagaaacaaaactaccagtgcaaagactgaacattggcgccaaagtatacaccaggaaataaacccaaggttaacagagcaggtttggggaggcaaaacagatgcacactaagggcaaagtgaaactgatggctaactacttagcataggagtatttcaccagggctgagcagagagggctgggagggcagaaccactgacctccagccgctgcagcttgtcccgtagtcgtgcctccaccgcttccccaccatccaccagacctcgag

SEQ ID NO: 15082 - DNA, 112 bp, Homo sapiens
aggagaatcgcttgaacccgggaggcagaggttgcagtgagctgagatcatgccattacactccagcctgggtgacagagtgagactccgtctcaaaaaaaaaaaaaaaaaa

SEQ ID NO: 15083 - DNA, 5262 bp, Homo sapiens
ctcccgacctcgatcagcctcgaccctcaggaccgccagctgcttctccaactcccggtcccggtgtcgcccagccacctcctggctctgccgttctgcctgcagttccttaagctcctcctgtgtccggagcagctcctggaaggaaacgggaatggtgatggggcacccagagccagactaagatacctgaatgtggagaagctgaaactctcatacactgccaagggaataaaaactgatgtggccactttggaaagtagtttggcagtttctcaaaaagttaaacacagatttaccatttatatcaccagcaattccactcttaggtaacccaagagaaccgaaaatatgtgttcacaaaaaaacttatacgcgaatgttcatagtagcattattcattatagcccagatggatacacaacccagatgtccacgaattgatgactggactaaacacggtatacccacagagtggaatgttattcagccataaaaaggaatgaagtactcatacttgctaccacatggacaaaccttgaaaacactatgctaggtgaaagaagccagacccttaaggcccatatattataggattcaattatattaaatatccagaataggtaaatccagagacaaaaagtagattagtggttgccattgggtggggggaattattgctaatgggtttggcgcctttgagggggtaatgaaaatgttctgtaattaaatagtgatgatggttgtacaactttgttaatataataaaaaccactgggggccaggcgccagtggctcatgcctgcagtttgggaggctgaggcgggtggatcacctgaggtcaggagttcaaaaccagcctggacaacatggtgaaaccctgtctctaccaaaaatacaaaaattagccgggcgtggtggtgtgtgcctgtaatcccagctgcttgggaagctgaggcaggagaatggcttgaaccagaaggcagaggttgcagtgagccgagattgtgccactgcactccagcttgggtagcagagtaagactccatctcaaaaagaaaaaaaaaacccattggattgtacacaaagatgacttttatagcatgtaaaatataactccataaaaaaaaaaataccatgaagggagagtacatgaaggtatggctagtaaggctggttgtttaaaaaaaatacagtgtgaggctgggtgcggtggctcacgcctgtaatcccggcactttgggaggccaaggagggcggatcacaaggtcaggagatcaagaccaacctggttaacacggtgaaaccatgtttcacggtgaaacactgagtacgtgtattttttttgtaaaaatacaaaaaaaattagccgggcgtggtggtgggcgcctgtagtcccagcaactcgggaggctgaggcaggagaacggcgtgaacccaggaggcggagcttgcagtgagccgagatcacgccactgcattccaccctgggtgacagagtgagactccgtctcaaaaaaaaaaaaaaaaaaaaaaatatatatatatatatagtgtggccatgggatctccaactgcatgcaagagcaacctggagagactttgacagaacaggtcagcacaatccctgcagctgccacttgtctttcgtgtgtgtgtgtgtgtgtgtgtgtgtgtgtataaaaccaaaatgtgtgacacaataaatgctggcacagctctgatttcttttaaaaagaaaattaaaataggagttctggttctaattattagctattagctacttctgaaattcagaaagtaccataattaggctaaagggttatataatatgtagtgaatcttcaatgtaataccatatactctgctatttttcttttgctaattagttttgttacattagtaaccaggccatgccaacacaagtattccagtccatgtgatgatatttctcaatgtaaattaataaactgaaattctaatggtaaacattttttcataaatgtagttagagacccctctgaaagacaaagcagcttttgccatgctgaccaaattagatttctgagcctgcaaaaatcatcctggagtttcacaaatccacctaaatgctgctacccatgacgtctcttgggagtcggccagcagcctctggctataccccaacctgggttctgagagcactttccattagaaacctctatgctcaatgaggagactggtgctgctgtgctggaaagagatcaagctgagcaggcaggatgaggcctggaaaccaagcacacaggagatagccccactagcaagaaggccctcatggagaggtaaggcaggtgttcatcacccctacctaccattctgccccccaattcccaaataccttcttgagcacctcaacctggcgagtatctccagcactagctcgggcctgctctaattccctctgcaagacctctatcttctctccaagctcctcttccatctcctccttctccattcgcagctgcaggagtctgagccaggcaaggtgaaataaaggggaaagggaacagagtaaggccacatgcctgggggaggttagcatgacaataaaagccacctctctggaggccaacacgctgggcaccaactctcaagaggaaggaaggtgaacgtggaaaagagcagtttgagaaatgggagagtaagagcataccatagatagaaaggaagtgggccaggcatggtggctcatgcctgtaatcccagcaatttgggaggccaaggcagatggatcacttgagcccaggagttcaagaccagcctgggcaacataatgaaaccccgtctctacaaaaaatacaaaaattagccaagtgtggtggtgcatgcctatagtcccacctattcgggaggctgaggtgggaggatggcttgagcccaggaggtggaggttgcagtgagcccagactgtgccactgcactccagcctgggcaacagagcaagaccctgtctcaaaaaaaagaagaaagggactgggtgcagtggctcacgcctgtaatcccagcgttttggggggccgaggtgggaggatcacgaagtcaggagttcaagaccagcctggccaatatggtgaaaccccgtctctactaaaaatacaaaaaacccaggcctagtggcaggcgcctataatcccagctactcgggaggctgaggcaggagaatcgcttgaacccaggaggcggaggctgcagtgagccaagactgcaccactgcactctagcctgggcaacagagtgtgactccatctcaaaaaaaaaaaaaaaggagaaagggggccaggcgcagcggctcacacccgtaatcccagtgctttgggaggcaaggtggacagatcacctgaggtcaggagttcgagactggcctggccaacatggtaaaacctcatctctactaaaaatacaaaaattagctgggcgtagtggcatgcgcctgtaatcccagctacttgggaggctgaggcaggagaatctgttcaactcaggaggcagaggttgcagtgagccaagatcgtgccatgacactccagcctgggaaacaagagcgaaactctgtcccaaaaaataaattaaaattaaaattaaaattaaaaattaaaaaaaagaaaggaagtggcatatgaatcatgggtatttctgagagggccaatgtccttactcctgcttggtggctctaagatcctccttgttcttctggaacatactctgccaatgccctgtctcctctgaagtctcctccagctccctctgcagccctcgcacaagggctgacatcttctgcctctcggcctccagcactgcatggtcctagagaaggggagagttggacaccagaaggctcagagggaagaggtcacttcaaatcaaagtgtgagtgtgtacaaggaaaggcttagacccagagggcaccatgccaggtgcaccccctgacactcttgtggtacctggtacaatgctagcagagattctctcctcaagtcacagtccacccctctatcatctacaggaaacctccccagttatttccccttgggactttttatttttagggggacagagtctcgctgtgttgcccagggtgaagtgcaatggcatgatctcggctcactgcaacctccgcttccttggttcaagcgattctcctgccttagcctcccaagtagctaggactacaagtacgcatcactacacccagctaagtttttgtatttttggcagagatggggtttctccatgttacccaggctggtctctaacttcctgagctcaagcagtccacccgcctcagcctcccaaagtgctgggattacatgcatgagctaccgcacccagtcccccttgggacttttgtcacacaacctcaaggtacttctggcctgtactccctccctctgcccctatagttttcctgcccaaggttttcagcagatctcactgtgtcctttaggaggagagggggagttcccagttgcaaccatgaaaagtccaaaagtccaagatcccaaggcagccttgttctccagcagtgccctcctctctcagaccctgctcttgtcacatgcctgggttgcatcttgcatgctcctgcggagctgctctgtgtctcgctggtactgctgccggacatgttccacctcctggtcacgggaggctacctcctctttcagggcccccttcagggctgtcaactcccgctcccgcagcctcagctgctcctctactcgctgtttcccctccaagacctcttccagaagttcccgggtctctaacaggtcctggagaaaataaaggaagaagtacaggggtgaccatattagaatccatctgtttatcaattcactgagtcaaaaaatatttatcgtattaggcacagtaccaggtgctctagtaccagtactggagcccagaatgataggtttcctttatcctaactctagtcccaacacaccattgaatctacctgaaagcacactgagtacctgtaatcagccacccactcctcatactttggggaaaccatggatgagcagacttgaggatgctccaactgagaaaaagcagaggctggggcatatgaccccagaccctaccttcagtaacacctccttagcaggctcaggaccctggacatgtttcagcttgttctgcagctccatcacctgggtctccagcccatgtcgtaaatcttcaccctggtccaagaggcgcttcatgttctggagc

SEQ ID NO: 15084 - DNA, 2216 bp, Homo sapiens
gctactcaggagactgggcaggaggattgcttgagcccaggaggttggggcttcagtgagccatattcacaccactgcgttccagcctgggtgacagagcaaggtgctatctccaaaataaataaataaatgttaaatttgcttttttctctctctctttttttatgtagaatttgtttgttgatacttactgaatgtagtgaccctgctgtggtaatgaacacttctagtgccttctaggcttaaaataccagacaaccccaaataacaaatgctcttttgtgttttgataggttggatttctgtttgcttaatattgggaatactgggggaaaaaaagatggtgttttcattctaaggattgtcctaaagaaagtgctactttatttttaagaaagtaaggccacttgttatataagaaataacaagttcccattgggtcccattttgcaaaaggggataaagaattagactgatagcatcatacgaggcatatttcactatacaaagtgttgtacacctgtctatacaactctcctacccagcttgacctcacttttcatacctgatgcagcaaacaattcagtgccataggagaaggaagcagcatggttataagtgactaacacgatattaggcaatttgtccaaatttctcattttctttataggtaaagatagcattcttatttgattaattttttgttccactggctttgaaagacaaacgattgttaaagataaaattgtttttgttctttttcttataggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagcttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacttagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaagcatgatcttacagatatgtttaagttaatggatgtaatgcagggttctacactgtatttgg

SEQ ID NO: 15085 - DNA, 3607 bp, Homo sapiens
gctactcaggagactgggcaggaggattgcttgagcccaggaggttggggcttcagtgagccatattcacaccactgcgttccagcctgggtgacagagcaaggtgctatctccaaaataaataaataaatgttaaatttgcttttttctctctctctttttttatgtagaatttgtttgttgatacttactgaatgtagtgaccctgctgtggtaatgaacacttctagtgccttctaggcttaaaataccagacaaccccaaataacaaatgctcttttgtgttttgataggttggatttctgtttgcttaatattgggaatactgggggaaaaaaagatggtgttttcattctaaggattgtcctaaagaaagtgctactttatttttaagaaagtaaggccacttgttatataagaaataacaagttcccattgggtcccattttgcaaaaggggataaagaattagactgatagcatcatacgaggcatatttcactatacaaagtgttgtacacctgtctatacaactctcctacccagcttgacctcacttttcatacctgatgcagcaaacaattcagtgccataggagaaggaagcagcatggttataagtgactaacacgatattaggcaatttgtccaaatttctcattttctttataggtaaagatagcattcttatttgattaattttttgttccactggctttgaaagacaaacgattgttaaagataaaattgtttttgttctttttcttataggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagctttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacttgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaa

SEQ ID NO: 15086 - DNA, 10685 bp, Homo sapiens
tcttgcttgttacaggattttatatttttttgtgatgccgttgcatcatggattaacccaaaagatgatctcagagacatgttctgtaaggtaactaataagtctttataatgcatcatcttgagactgttaatatcctagtggaaaactttaaattatgtttacattttttgtgaaagttaggctcttcaagtcagtattgatagtttacatatataacctttattcttggtaacaaagttggcttgatcttttcttaaaatacagcagtgactcttatctgtagaggatgcactttgaaagtattttcccaagtgtaccactagtttaggtggtcccattattccatttaaggaaaatagtatatgtttttcaagatggaaatggagacttggagtataatctgaaaaagagtaaatctaaatggctgccacaggagtaagcccatgtcattatttgctttgttaataccctcttttgattaactcgtcagtactcaaccacagtaaaaaataaaatgcagttacacatttgaatcacccaagattaaagttagtgaactatagtttgtcatgaactcaaagcttgtgtatttgcagtttgaaaaaatacgacataaaaattgtattgcttggatgacttctctactttatcttttcattagtatggtatcagagattgcttagagtatatctgttactggaacacttgccaaagtctaaacttctcaaagcagagtttaagcatatgctatgaggtacttttaggcaaggcacgtgtattagtccatattcacgctgctgataaagatatgcccaagggccaggctcagtggctcacacttgtaatcccagcactttgggaggccgaggcaggtggatcacctgaggtcaggagttcaagaccagcctggccaacatggtgaaacgccatctctactaaaaatacaaaaaattagctaggggtggtggcggatgcctgtaatcccagctactcaggaggctgaggcaggagaatcgcttgaacccaggaagtggaggttgcagtgagccaagatcatgccgttgcactccagcatgagcaataagagtgaaactctgtcccccccacacacacaaaaagatatgcccaagactgggtaatttacaaaagaaagaggtttaattcgactcacagttccatgtggttggggaggcctcactgtcatggtggaaggtgaaagacaagtcttaaatcgcagcaggcaagaaagagaatgagaatcaagtgaaacgggtttccccttatcaaaccgtcagatctcatgagacttattcactaccaccagaagagtataggaaaaactacccctatgattcagttatctcccactgggtccctcccacaacacgtgggaattatgggagtacaattcaagatgagatttgggtggggacacagagccagaccatattagcagggaatggtgtagaatcctacgaagtttgagaattgctactttaaaatggataaaatttataaaaaaatcagctgtgttagatttcagaagctatgctgatctgaatttttctcttgttattgataaattaatggtttttcactcttacagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtaagttataagaagtttggaaattttcaggatgaagaaaattttgttagggctgtcatttcaaactactaaatagaataaaaagctatttgttttctatagaggttgaataaaacatagcctcatatcattctatcttgggctttaaatttaaaattacttaagtgggccaggtgtggtggctcatgtctgtaatcccagcacttggggaggccaaggtgggcaggtcatttgaggtcaggagtttgaaaccagcctggccaacatggtgaaaacccatctctactaaaaatacaaaaattagccacgtgtggtgggacgtgcttttgtagtccctgctactcaggaggctgaggtgggaatatcgtttgaacctgggagatgggggtagcaggtgagccaagatcttgccagtgcactccagcctaggggacagagcaagactccatctcaaataaatagaaaataaaattactcaagtgaaggctaaagaaattttcttaatagaaccaacaagcccagaaaaacgattagctccagtttgaatcgtaggtataaagaaatccacgttggtacactggttggatttctcaacattgcttcaactattccttttttctttcttttttcctgcaagaagacatcggcactcatagtgatggggtaaaattgatttcattttggagcatgaatttatagtctctgctgtaacaaggacttttcatttcacgtgctttgaaagaaaactcagttgggttttggcccactgtttttgtttttcactgtatgtttcactgagtacctaccatgtgcccatcactttttttttctttttttttttttttttttttttttttttgagacagagactctttcgcccaggctggagtgcagtggcgcaatctgagttcactgtaatctccgcctcttgggttcaagcaattctcctgcccgagcctcccaagtagctggcattacaggcacatgccaccatgcctggctaatttttgtatttttagtagagatggggtttcaccatgttggccgggctggtctcgaactcctgaccttgtgatgcacccacctcggcctcccaaagtgctgggatttacaggcgtaagccactgagcccagtgcctaggactatattttaaaataagcaatgaaagattctgttttaatttgggatggactatattcatttggactcttgctccttgagctcttctgtacttaaatgggactagcagttctcatctctgagcttcggttttgtcattgagttatgttgaggattaaatactatactgtatgtgatgccagaacttagtatgttgcctggcacactaagttgactcagtaaaggttaggaactgggccagtacaataaatatcagggttttgacattcatctttagattttcaacatgaattaagacatatctgactggaagccagaagatgtgctgaatgagcatgtacagaagatgtacaccaagttgaattacactttagattgaattggaggagtttttttggcttgcttgcttgcttgtttactccaagctaaaatttaaatctggaaagatttcaccatccaagctgtctaacctagaaggtagtagaaatggactcaaagcttccagaatgtgtcagagcccttcatatgtgttgtcctacttcagtcttgagtcctcaagagctgttttccaaaatggctttggcattttggaaaagtgctggattcaccttatgttaaattatgagaatgcaaaagatgagaatgacttgtagcttcaaagcttcaatgagctactaacaagtcttgagcactttcagatttattacctctgtggtctcatcaccaatcatgaattaactgttctaagacaaggtatgaaatagttctcggttttgtaattagagctaaaagtagatcagtatcttttattcctgcctttttgtactcctcttccttttcttcagaggcaggagaaaagggattgcttatatttctacacagatggattaactgccctctgtgaattcacatgaacgttcataaatggccaaaacttggcatgattgggtagtagagttctgtttgtaaaaggaccactatcaggtaacagtttaaatctcccagtaatcttaccttatttcttaatatcctttttatcattaaaactgtttagcatagaaaaaagttcctaccagaaaaaccaagtgactggaagatagtggaaatgaccaagtgaaataggatcagaatgggaactaattaggaacatcaagaaggcaagtgtaggcagggtgtgatggcccacatctataatcctagcatttcgggaggctgaggtgggagcattgcttgagcccaggagtttgagacctgcctgggcaacatgatgagacctccatctctatgaaaaaaattaaaaagaaaaaaatgagctgggcatggtggtatgtacctatggtcccagctactcaggagactgggcaggaggattgcttgagcccaggaggttggggcttcagtgagccatattcacaccactgcgttccagcctgggtgacagagcaaggtgctatctccaaaataaataaataaatgttaaatttgcttttttctctctctctttttttatgtagaatttgtttgttgatacttactgaatgtagtgaccctgctgtggtaatgaacacttctagtgccttctaggcttaaaataccagacagccccaaataacaaatgctcttttgtgttttgataggttggatttctgtttgcttaatattgggaatactggggggaaaaaagatggtgttttcattctaaggattgtcctaaagaaagtgctactttatttttaagaaagtaaggccacttgttatataagaaataacaagttcccattgggtcccattttgcaaaaggggataaagaattagactgatagcatcatacgaggcatatttcactatacaaagtgttgtacacctgtctatacaactctcctacccagcttgacctcacttttcatacctgatgcagcaaacaattcagtgccataggagaaggaagcagcatggttataagtgactaacacgatattaggcaatttgtccaaatttctcattttctttataggtaaagatagcattcttatttgattaattttttgttccactggctttgaaagacaaacgattgttaaagataaaattgtttttgttctttttcttataggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagcttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccaggggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttattttattcacctttaggctttccaatgaattgtgactaattttttcaatcttacatagatctttcacccattagcattacttacgtagatattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactatagat

SEQ ID NO: 15087 - DNA, 14889 bp, Homo sapiens
taatttccaaggaatggaaatcactttcacctgtattagtttgagatgcttgagaaatataatcacatttactgatattttctcatgaaaaaaactatagattttattattaaattctgaaattttggctggcttttgaatgaaggttctctaaatttgtccatttaactgctcatcttattaacagaatgataccttgacactcgattgagcgagaaaagcaatttcatcatggtttttggtgttctctcaatctttagatttttttaattccttttgtttttctttttccaagagtatgccatatatgttgctgccccttattttagggggtggtaataaacagcactggtgaaatcttatgtttattatcatacacaaattctgttggtttctgtttctgagttatttgttgttttttctttattttttctccttccccctcatttgctcatgtcttggttggcgtttggtggtgtataaccgtgattgcgttaccttagcaataacaattggtcgtcttggttacgtttgtcctcaagaggtggcccccatgctacagcagtttataagaccctggtgtgtattattcaatctttttttttaattcatttttcttcactctttctttctctatctcacttttagatatattttcagttggttacaaaaatcacaatcctttatcattgccaaccatgtgactaatcttgtcctatcaggtttgtgaggtttttcaatagcatcgtcatgtatatttattttatgttgtggctaacgactaattgatgcatgggataagattgtcacatgcttgctgtgttaaaaaagcttgattatacataaaaagcatttaaatatccaccagaaaaataaagatgcatgcaaattctataaatttaggtttttgcattacgtttcttttttagaattaatttggaaacttggattgcattaagaaatacatgtttaaatttgttatgtataaaaatattatttgcttgttaatgtaaaagttaaacatctacaccataagctatatagtaatagtttatattgtggcactatatcctatgttttgcttctttcaattgataatctttcaattcaaatcattttagtagtgtttaatggaatacaagtcatgagtacaattttaaaagttaatttggtaatttgttcttcttggctcaggctcattaatagtttaaatgggagattcaaattagttatctactttataaatgcaatttattaagaaaatgtggatttcactgtttctactgtattgagataagatgggcccaacaaacaggaagtatgagtaaacgaaactaaagctttccgaaaaactcttttaatataatcattatctatactgtggtgcttattccattaaatactgtccattagtattgtcattgaatctgcttgttacttaaatgctaaactcaattctgtaattcaataggtgcacctctctgagaaacataagagacaatgaggaaaaggattcagcattccgtggaatttgtaccatgatcagtgtgaatcccagtggcgtaatccaagtaagatgttcacaaagatttgtttttaatgtctaattaataaaattttaaaggaagaaacattctaatactttaattataaaaagttaactattttcaaaggtatcaaaatacagttaaacctttaaaatgtatatttcttaatatcttgaaattgtaatgccttttttttttcctaaattttttttgtcatgaaatgagatagtaacagcagattgggacaacaaggttatattcttgtcttgaatcaggccatggcttctttcatccaaatttcagacctcatttatttactttgtccctgcctcccatccctggatatcagtttgtggatatctacagttaatagagtgaccaaatagtaggaatactgtctctctattctgaataaaatactttgaatcagatttagaaataatgaataaaatacaaatcagccattgaaattgctctaattttgagagcttatgatttattcatctttgttttccaagttcaagttatatgtagacattttaattattcggcagtagtattgaacatgagtccagttaagcatctggatccaactgccaattttctagacacacaaaacaaaaacatgttgaattacaccatgtatattcagtgaacaaaatgctaactgtgggactctaggttaaatacctggattcttcagcagacacgtttaaggaaaagaaagcgtggaaggaatcctgtagacaagagacccaagatacatcaaatcaattgaaaaacgtagttgaggccgaggcaggcagatcacgaggtcaggagttcgagaccagcctggtcaacatggtgaaaccccatctctacttcagataaaaaattagccaggcttggtggcaggtgcctgtaatcccagctctcgggaggttgaggcaggagaattgcttgaacccgggaggcagaggttgcaatgagccgagatcgcgctatggcactccagtctgggggacaagagcgagacttcatctggaaaaaaaaaaaatgtagttgagggagggaagcaaagaactaaattttggtttccaggaatgcacacaagagttataaaactgccccaaaaaaatgcttttatagcaataactttctcacatttcttaattttcaagaaaattgaaactttccactccgagaggggtgttttgaacatttttaaattgtgaccttttgatgtttcctagctcgtattgtggtttttcttaactcggttttagaaacgttaattctgttttataaaattcaaattgatacaggtgatagacgttgaaaacctacaagttagaattagaaaataacttctgactgatttcacactcataaaatattcataacttactgttagaacaagccagtgccatcttgagaggtttctagttacaaaataagcttttgacattttctgggtttttgtttttttttttaatacttaagaactttgtgtgatctcaaatgtgtgctagaggtatctgatatgacatgtaccatctttttcaaaagtatcttccgaccaagattttattgtttctttgtttttgaattaatgttttaagatgataaaagtagcacatgtatgatcataaaattgttaccaacttaagagttggtagaaatttctgttttataacttttattcacataccttattttggatatggttaaaataaaatgtcataggtttatttacatttaaattttttaatcacaaattctgggtatctgtgcatttaaatttttaacatcagatttggtatttggaagacataatttgaataaattgtgttaagcaaatcttttttgcttaaataaacatacacacactgtagtattaccaaattttttgaaattagtgaagttttctgaatataatagtaaaatttatagttgacatgtcagaaaatcagcaatatgttgaatgctgtttgttgaactgttagtgtttcagtatgataggcaagattgagaatattttaatgaaatgcttaaagcatattattatcttgttcttatagtcagaatagcctgattatcttttaagtaattgtccaaaagttgggttttttgttcttgtttggattgggtatttgtaattacataattagtttttcttcaattttttggttgtttcaactaagttatgtctgaaaatggaccttgaaattactaatttctctatttcaaatcaaggtcatttaatatatatttagctagctttaatttctttctaggccagtcaaaactgtaagatcattggttttatgtttttctttaatccggtaaatgaaagagtatttttatgggtgtcgatttggtgctttcagttcatttctgatgctgaacatttattgcacagggggttattttgttgtgtgatgcaggacattaaagtccagtataaactgaatgagttgaggttccttgactgtgggctaatagggacagccattaaggtaatctcttctaattccttatgatcatagttaatttttaaatgtttccttttttaagctagattctattgtgacataaactctgaggtttacatatatcttttgctgagtttgacaaatacaatatcaacctaagatgtatttcttgcttgttacaggattttatatttttttgtgatgccgttgcatcatggattaacccaaaagatgatctcagagacatgttctgtaaggtaactaataagtctttataatgcatcatcttgagactgttaatatcctagtggaaaactttaaattatgtttacattttttgtgaaagttaggctcttcaagtcagtattgatagtttacatatataacctttattcttggtaacaaagttggcttgatcttttcttaaaatacagcagtgactcttatctgtagaggatgcactttgaaagtattttcccaagtgtaccactagtttaggtggtcccattattccatttaaggaaaatagtatatgtttttcaagatggaaatggagacttggagtataatctgaaaaagagtaaatctaaatggctgccacaggagtaagcccatgtcattatttgctttgttaataccctcttttgattaactcgtcagtactcaaccacagtaaaaaataaaatgcagttacacatttgaatcacccaagattaaagttagtgaactatagtttgtcgtgaactcaaagcttgtgtatttgcagtttgaaaaaatacgacataaaaattgtattgcttggatgacttctctactttatcttttcgttagtatggtatcagagattgcttagagtatatctgttactggaacacttgccaaagtctaaacttctcaaagcagagtttaagcatatgctatgaggtacttttaggcaaggcacgtgtattagtccatattcacgctgctgataaagatatgcccaagggccgggctcagtggctcacacttgtaatcccagcactttgggaggccgaggcaggtggatcacctgaggtcaggagttcaagaccagcctggccaacatggtgaaacgccatctctactaaaaatacaaaaaattagctaggggtggtggcggatgcctgtaatcccagctactcaggaggctgaggcaggagaatcgcttgaacccaggaagtggaggttgcagtgagccaagatcatgccgttgcactccagcatgagcaataagagtgaaactctgtccccgccacacacacaaaaagatatgcccaagactgggtaatttacaaaagaaagaggtttaattcgactcacagttccatgtggttggggaggcctcactgtcatggtggaaggtgaaagacaagtcttaaatcgcagcaggcaagaaagagaatgagaatcaagtgaaacgggtttccccttatcaaaccgtcagatctcatgagacttattcactaccaccagaagagtataggaaaaactacccctatgattcagttatctcccactgggtccctcccacaacacgtgggaattatgggagtacaattcaagatgagatttgggtggggacacagagccagaccatattagcagggaatggtgtagaatcctacgaagtttgagaattgctactttaaaatggataaaatttataaaaaaatcagctgtgttggatttcagaagctatgctgatctgaatttttctcttgttattgataaattaatggtttttcactcttacagatccttcatggatttaaaaatcaagttggcgatgaaaattggaggcgtttctctgaccagtttcctcttcccttaaaagagcgtcttgcagctttttatggtgtttaatctaatacacttaagctgcagtcccaaaattaggggtaagttataagaagtttggaaattttcaggatgaagaaaattttgttagggctgtcatttcaaactactaaatagaataaaaagctatttgttttctatagaggttgaataaaacatagcctcatatcattctatcttgggctttaaatttaaaattacttaagtgggccaggtgtggtggctcatgtctgtaatcccagcacttggggaggccaaggtgggcaggtcatttgaggtcaggagtttgaaaccagcctggccaacatggtgaaaacccatctctactaaaaatacaaaaattagccacgtgtggtgggacgtgcttttgtagtccctgctactcaggaggctgaggtgggaatattgtttgaacctgggagatgggggttgcagtgagccaagatcttgccagtgcactccagcctaggggacagagcaagactccatctcaaataaatagaaaataaaattactcaagtgaaggctaaagaaattttcttaatagaaccaacaagcccagaaaaacgattagctccagtttgaatcgtaggtataaagaaatccacgttggtacactggttggatttctcaacattgcttcaactattccttttttctttcttttttcctgcaagaagacatcggcactcatagtgatggggtaaaattgatttcattttggagcatgaatttatagtctctgctgtaacaaggacttttcatttcacgtgctttgaaagaaaactcagttgggttttggcccactgtttttgtttttcactgtatgtttcactgagtacctaccatgtgcccatcacttttttttttcttttttttttttttttttttttttttttttttttttttgagacagagactctttcgcccaggctggagtgcagtggcgcaatctgagttcactgtaatctccgcctcttgggttcaagcaattctcctgcccgagcctcccaagtagctggcattacaggcacatgccaccatgcctggctaatttttgtatttttagtagagatggggtttcaccatgttggccgggctggtctcgaactcctgaccttgtgatgcacccacctcggcctcccaaagtgctgggatttacaggcgtaagccactgagcccagtgcctaggactatattttaaaataagcaatgaaagattctgttttaatttgggatggactatattcatttggactcttgctccttgagctcttctgtacttaaatgggactagcagttctcatctctgagcttcggttttgtcattgagttatgttgaggattaaatactatactgtatgtgatgccagaacttagtatgttgcctggcacactaagttgactcagtaaaggttaggaactgggccagtacaataaatatcagggttttgacattcatctttagattttcaacatgaattaagacatatctgactggaagccagaagatgtgctgaatgagcatgtacagaagatgtacaccaagttgaattacactttagattgaattggaggagtttttttggcttgcttgcttgcttgtttactccaagctaaaatttaaatctggaaagatttcaccatccaagctgtctaacctagaaggtagtagaaatggactcaaagcttccagaatgtgtcagagcccttcatatgtgttgtcctacttcagtcttgagtcctcaagagctgttttccaaaatggctttggcattttggaaaagtgctggattcaccttatgttaaattatgagaatgcaaaagatgagaatgacttgtagcttcaaagcttcaatgagctactaacaagtcttgagcactttcagatttattacctctgtggtctcatcaccaatcatgaattaactgttctaagacaaggtatgaaatagttctcggttttgtaattagagctaaaagtagatcagtatcttttattcctgcctttttgtactcctcttccttttcttcagaggcaggagaaaagggattgcttatatttctacacagatggattaactgccctctgtgaattcacatgaacgttcataaatggccaaaacttggcatgattgggtagtagagttctgtttgtaaaaggaccactatcaggtaacagtttaaatctcccagtaatcttaccttatttcttaatatcctttttatcattaaaactgtttagcatagaaaaaagttcctaccagaaaaaccaagtgactggaagatagtggaaatgaccaagtgaaataggatcagaatgggaactaattaggaacatcaagaaggcaagtgtaggcagggtgtgatggcccacatctataatcctagcattttgggaggctgaggtgggagcattgcttgagcccaggagtttgagacctgcctgggcaacatgatgagatctccatctctatgaaaaaaattaaaaagaaaaaaatgagctgggcatggtggtatgtacctatggtcccagctactcaggagactgggcaggaggattgcttgagcccaggaggttggggcttcagtgagccatattcacaccactgcgttccagcctgggtgacagagcaaggtgctatctccaaaataaataaataaatgttaaatttgcttttttctctctctctttttttatgtagaatttgtttgttgatacttactgaatgtagtgaccctgctgtggtaatgaacacttctagtgccttctaggcttaaaataccagacaaccccaaataacaaatgctcttttgtgttttgataggttggatttctgtttgcttaatattgggaatactgggggaaaaaaagatggtgttttcattctaaggattgtcctaaagaaagtgctactttatttttaagaaagtaaggccacttgttatataagaaataacaagttcccattgggtcccattttgcaaaaggggataaagaattagactgatagcatcatacgaggcatatttcactatacaaagtgttgtacacctgtctatacaactctcctacccagcttgacctcacttttcatacctgatgcagcaaacaattcagtgccataggagaaggaagcagcatggttataagtgactaacacgatattaggcaatttgtccaaatttctcattttctttataggtaaagatagcattcttatttgattaattttttgttccactggctttgaaagacaaacgattgttaaagataaaattgtttttgttctttttcttataggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagctttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagcagaaatgccagaaataaattaattgcatcttagtctaaatttaagtcctttgccatgaggaaaaagtggttttttgcttcatatggtaaatctatattattcatattgaatgtattaacagataatggtgcaaaagcattcttcccaggggaagagtgtatcatgcataactgcaatttaagtccttcctttgataatacttcaaaacatacacagctttgcttactgaattatttttgcaaataatacaaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactatagat

SEQ ID NO: 15088 - DNA, 607 bp, Homo sapiens
gtcttgagcactttcagatttattacctctgtggtctcatcaccaatcatgaattaactgttctaagacaaggtatgaaatagttctcggttttgtaattagagctaaaagtagatcagtatcttttattcctgcctttttgtactcctcttccttttcttcagaggcaggagaaaagggattgcttatatttctacacagatggattaactgccctctgtgaattcacatgaacgttcataaatggccaaaacttggcatgattgggtagtagagttctgtttgtaaaaggaccactatcaggtaacagtttaaatctcccagtaatcttaccttatttcttaatatcctttttatcattaaaactgtttagcatagaaaaaagttcctaccagaaaaaccaagtgactggaagatagtggaaatgaccaagtgaaataggatcagaatgggaactaattaggaacatcaagaaggcaagtgtaggcagggtgtgatggcccacatctataatcctagcatttcgggaggctgaggtgggagcattgcttgagcccaggagtttgagacctgcctgggcaacatgatgagacctccatctctatga

SEQ ID NO: 15089 - DNA, 607 bp, Homo sapiens
gtcttgagcactttcagatttattacctctgtggtctcatcaccaatcatgaattaactgttctaagacaaggtatgaaatagttctcggttttgtaattagagctaaaagtagatcagtatcttttattcctgcctttttgtactcctcttccttttcttcagaggcaggagaaaagggattgcttatatttctacccagatggattaactgccctctgtgaattcacatgaacgttcataaatggccaaaacttggcatgattgggtagtagagttctgtttgtaaaaggaccactatcaggtaacagtttaaatctcccagtaatcttaccttatttcttaatatcctttttatcattaaaactgtttagcatagaaaaaagttcctaccagaaaaaccaagtgactggaagatagtggaaatgaccaagtgaaataggatcagaatgggaactaattaggaacatcaagaaggcaagtgtaggcagggtgtgatggcccacatctataatcctagcattttgggaggctgaggtgggagcattgcttgagcccaggagtttgagacctgcctgggcaacatgatgagatctccatctctatga

SEQ ID NO: 15090 - DNA, 315 bp, Homo sapiens
attttgtgctatacctttaatagcagaaacagaatatttattttttcctgtggtccacatatcatatgtcattgcagtggactgtaaatttcctttattagaattttatttcaaacatggcttaaagttagtggactgttacctgagttatcagaggtttgacaacatgagatttgacattgtagcatagcaatattctaatccattcattcagtgagtaccatgagacttaaaatctgacagttgattttgatgtaaggtaacaaatttccactggttggtttggcaaatgttaatcaaagaaaaaatttttga

SEQ ID NO: 15091 - DNA, 1432 bp, Homo sapiens
ctataccaagtttctcatttgtgagatggaggtattatttacttcgaaatggtaaagggaaaacaagcaaaagcatttgcaaatgctctgtaagtaaacctatatcatgaatgtattttcttggccagaagtactggtacagaccgttaagtatggagggataccagggcagtcaagacctgcactgggtacatagaaacattttggcttggttagacagtctctgtttcctgtaccacaggttttcctgacagcctgtgcaagttaggacttttgatcttaatatttgtacagcttgtgagttaggtgaattatttccaccaaacaaaacattttacgaatataagcatccagatggcctatctcaactcccatggcccccaccagacactatatcaatatgtttcttatcagttttgaaattttctccttaagtttcatttagcatattgctgaaagtgggttaaagaggcccaattagtgagatcccagctgggacttttagatgggaaatatgcaggattgccagatgagatcatgggcctgatctagtgtttatctgttaaatctgtttataactgcttaactcttgacttgcagacttttaaggcagccatttgacgtcacagggttgggaacgaggcttgtgccagtataaagccgctgtgatgtggggccattgggcccttctgtttttctcaactatgtgcatgcactttggagcttgacaaacagccgtgtccagtgaactccccccaaagaaaattgaagttgactcaccgtgaaaggcataccaccaaaagtgactcctaacccatgtacaattcagaaagaaagcactagttaacaagtgcccagtgtgtgattatttagttctagaatctgtccagattttctttgttctggctctgttctcttcatggtggccctgcagtttttagatgttataaaacctccctacgattataatagcatgtaagttaaaagttgttgtgaaaaaacaaatgaagatgcatttataagtagtcttcagtctttgcctgaagaagagtaagttggttatttgaatttatgaagcatttacataggaaactagaaaataaaacactaataaaagcgccttgccaggagcagtggctcacgactgtaagcccagcactttgggaggctgaggtgggcagatcacctgaggtcaggagttcaagaccagcctggtccaacatggtgaaaccctgtctctcctgaaaatacaaaatttagccaggcatggtggtagcctgtaattcccttaggagactgaggcacgagaatcacttgaacctaggaggcggaggttgcagtgagccaagatcgcaccactgcattccagcctggatgacagagcgagactccatctcaaataaataaataaataaataacataaacaaaaaa

SEQ ID NO: 15092 - DNA, 9925 bp, Homo sapiens
gatagaataaccaatttaaaatgtcttatagataaaatctagaatgaagctttggtaagaagtctgagctacgtacataagattatcagcaacatatatgttaaggtggagccatttaaagaaagaacagaagggacctatgatttactgattgttgaaaatcaaaataaaggaggcagagaaaataaagattgtgagtcagcaggacttttgtcttattttcaagtggatttattgattacttttcttcttacagccaagtgcaagatctgtgaatgggcgtttgaaagtgagccactatttctccagcatatgaaggatactcataagcctggagagatgccttatgtttgccaggtattgcctttttctccagggagttttagcagttttgccctcaggaagaatacaaagaatttactaatgaatattgttgaccacctactgcatacactcagtttaggaactctgagtaggtacagaagaaatagtaaacacagtttatcttcagggtttccatgcaggagaaaaacataaaagaacatgtccacaagtagactagccgggaacatgtgcatattctaagggagtgtctgtctcctgaacgtgccctttggaaattgacagaaaaggctttatttttcttagttagagaacatggattattcttagactttctgtcccttcctatttttaaagtaatagctaaacctatcacaaacatagcccagcattacaaagtcaggaaaataatttgatttctatgcatttgagaaaactttttttttttaatttaaaaatttttgttgctacctttttttttaaggcctctcagttgttcacttcattcttagccttattttccctcctatgtgactcaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccaggtactaggcaccaagcaattcccatattctcttgttttttttttttttaaacatggatgctggggccagggctgagctaggcaaataatttgggcagagattataatatgcatatgtttgcagaaatttattgaattcacttaatgtgccatgtactagtctagatgctagagatttagtagtaaacaaggcaaacaatacaataaaacatgaagagtactgtgttggggaaattataggatatagaaaatcacatagctattctgggtgcctagtaaggcttccagaaagaagtgttgttcaatacctgagggatgaataagaatgagccagatgaaataagacgaagaacagtgtgcccaaggcacaaagcaaaattgtggaggttcaagaaattgagagagattcagtgtagggtgtaagagacagaggggttggaagttaggcagggacagatcatggaggatcttttaagccatgaaaagaattcactgggaagccactaaaggggttttaagccctggagtgatgtgttcagctttagttaaggctttatactgcctgcactgcagagaatggattaaaggagattgagactacagttagggaaactagctagaaggcctttttcagtagtttaggtgagagatgatagtggctattggcttttgaaataaaaagagggtagagttgagagatattcagaagatttgtgatatttatgatgtagagatggattaggtgaaggtagcaatgcagtagttaagaatagtgcctaaaattctgtcttgggcagttgggtgaatgagggaactatttgctgaaatagaaacaatagagaaagtatatttgtgaggggggagatcatgagcttggatattgtaagttagcagtatctgtggatgtcaagtgtagctgttggataatagatctcaagcctgtgagagaactctgggttgtagaaaagatttaggaatcagcgttatataaatcctatagattttaaacttaaataccatgggccccccaaccctgttgagaataagagaaggcttaggatatttgaagtcccttatctataaagcaaccaccatagtactaggaggaaaaccagaagagtcttaaccttaaggaaactggggagaagaaagtgttttaaagaaaagggtgtgatcaaaatgtcatatgttacaggaaggtgtcaagcaacatagagacttagaaacaggcctttaatttagcaacattgatgagagccattttgttggttggtagggtggaagtcacatttcagcagaacaaatgaatgagaggtaaggaaatgaagacgatgtatttaaagaagtttatttataaaaagggaggacccagggtaggtaaatccagaggaagaagtggcaaagaagagttttttattgcttttattttccttataagatgaaaagctatgacttcgttttaaaatactacaagaagagagccactagaggagagtgaaaggtatatagtatataagagaggattcaaaatggagaataagatgagtgcatgtgtgcttaatagtcacatacatatgcacacaaacatatgtaccctattacactcatagtctcctttgcacagtagtgactgctgattgtctaccacaactgtatttccaaataggggcatggaaattgtctcttagcctaagcttacagagctttgttatcctactaaagaaaatcatagacatgggttctatttttgaaggacttcaatactaggcagactgaatcctcaaagtggtctcaccaggagacatatctgtatatactgatgtgttaagtgagaaaacagcaaggtatagacaagtgctatcatttgtgttaaaaggagaaaaagaagagggctgaggtgggaggatcacttgagcccaggaggtggagtccagcctgggcaacatggtgagacaacatctctacaaaaaggaaagggaaaaaagtaagggccaggcacagtgatgcacgcctgtaatcccaacactttgggaggccaaggcaggtagatcacttgaacccaggagttgaagaccagcctgggcaacatggtgacaccccgtctctacaaaaaaatacaaaaagtagccgggcgtggtggcacgtgcctgtagtcccagctacttgggacgtgcagtgagctatgaacatgccactgcactccagcctgggctacagagagagaccctgtctcaaaaaaagggggcgaggcaggtaatgattggatatgaatgtatttgtgatacagttatatgtgtagactgcccacgaaagcatactcaggaaactggtaataagttgtttgtatggaaggggactgagtgttggagttgaaagcaaagttggaagagtatagaaaaaaaagtatgactttagtttactatgtacattgtccttttttaaaaaaagaagaatgaagaatgtccagaagaatgtccagttgtcagcagtgtaaagatataatacaaataaaggttacatcactcattcaaattgttaaaacaagtcaggaaaggatgatttgagaacttagtcatcctggactagaatccatctttctttgatatcatgggaggtgatgattctcaatggtaggttttgtggtcatgttgcatatttctttcttactctcttaaattatcaacagaaaggtgggaagaatgatatggttgacattgatctgctttctcctcaaaaaagaaaatttattaggaacctttaagggattttgtctctttttttccctcccccacttcagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtaaagagtttgccagtgtcttttataggcccagggagggaggaatagagattttcagtattctgaaatttagtgtgggtgatgtctcattgttacttcccttggttctcaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgtcagcgccttcttctaagtgctgggcgggtggggactgggtggccaggattattcctgatacacagtgcaatctggtagctttttagcagggtttgttgtctgaaaatcctacattttggggacccatgaggcagtaatgagaattctttttttttctcccccacaggagtgtcatgggccggcagacatgcctggagtgcagcttcgagatcccagacttccctaatcatttccctacttacgtacactgctctctgtgtcgctatagcacctgctgttctcgagcttatgccaaccacatgatcaagtaagttggtttttaaccagtgttttagcttgagagttcagattctttttttcttcttcttcttcttttttttttttttttttgaagacagggtctcactctgtcccctaggctggagtgcaatagcatgatcttggctcactgcaacctctgcctcctgggttcaagtgattctcctgtctcagcctcccaagtagctgggattataggtgtgcaccaccatgcctggctgatttttttgtatttttagtagagacggggtttcaccttgttggccaggctggtctcaaactcctgagctcaggtgatccacctgcctcggcctccctaaagtgctgggattacagacatgagccactgcgcccggccccagccagattcttgagcactcatttcattttctcccctgcttctaatatgtttcctccttcaactcttagagctatttgttcttctctcctagcagagtgagaggctctgttttttcggttttgatggtctgtgctctaatttcatagggccttgctattcaagtaccagtagtattaggtgggagcttgttagaaatgctgactctcagccccgccctaggcctactgaaccagaatgtgaattttaatagatcctcagtgacttgtatgcatattaaagtttaagaagcatggtgacaggaaaactggcttaggttgagattagggtgcactgaagaagtgtctcttttgttgggggcattgtcactggctggtgatctctagcttagccagcagaactccgtaactcataccacttctttgtctttctcagcaatcatgttccacggaagagccccaagtatttggctttgtttaaaaattctgtgaggtaagaaaaaacttattggcagcatcttaatttttcaggtttttacattaattttcaggtttttcattatttggagaggtggttatgtgaattaatttcagaaaaaggagaaagtgggagggcattccttttctttcttaagcctcaaagcttaatggtctcaagtgtcactgctgtgtttgtcttacatagtctcaattctcttttttagtggaatcaagctggcctgcacttcatgtacctttgttacctctgtgggcgatgctatggccaagcatttggtattcaacccctctcacagatccagcagcatcctgccacggggtaagtaggagagaaggggattagttgagcaaggggaggaaaaaagatacaggttcgtactgtatgcatcaggagcatacctacttggcctcactcattcactgttgagatgtgctggacctaattagaaaccttccgacctgaagtttatataaaactgggaaagctggtcactgcgaacagcgtatttgtatgtagtaagttgaatcccagggcactgtctttggagggcttattttttcactgagctaactatttttgttgtttcattttccataggactcacttggatagctcactcaaggtaacaaaaactcacctcacaatttaatttctggtttgcagtgtgtttactctgttattattattattattatcatattattgtttcaatttcctagttgaactgagatttctcctcttctctttgctcctcacccctttaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgagtcttccactccacgacccagatcatctcctgaagagacaattgagcctgaaagtcttcaccagctctttgagggtgaaagtgagaccgagtctttctatggctttgaagaagctgacctagatctgatggagatttgagtgttggggtcattagggggtgtgcagtgggggtggaaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttctacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtt

SEQ ID NO: 15093 - DNA, 2386 bp, Homo sapiens
tcagcaagcattttgaagaatttatttactttacaaaagaagagtctatctttgaactagccaagttcaaagttaaaagtagggcaacttcagttctggataatgcatctgtatttcattcaaagccactaaaaaaggaagacagaataataaaattgtgaagcataaagggatcaattcctaaaaatagctgtactgtccaaccaaaactttccacccagaaaattttcctgggtgagcctcccagaaaagcccagcttagtgtaagccaaagacctcccaagtctgtcaccaattttttccctattactcacctgatcatgtgggcaatatcccagttggtctctgtagacaatggtccctctatttcaacacctttttcggtgacagtggcggtttgaaactggaagaaagcagagcattcaataatgcccacgccttaagtccttaaatgaaaggtcaggtggaggtcttccccaatgtgaaaataggagtcacacaagtaaggcaatctgttcttcaaagcatagagacccagggattgcaagtagccagagcccgccaattaggttcccagcacatccctcacccggttgtaagaacgggcatctcggtagtacagcactcgcatgcagcgttctactaagtcgcgggcctcggtctggcttagcactggctgcttctccagaacttctcgcagcagaggctagggagattgggggaaaaccatggggggatattgggctgaataacaggctagttgtctcaaatctatggtataaaaagcattagagtgaaagatgacattctacttcttgcctcaccagaatgaactctgcttagaaaataagctaagagccacttcaggaagaagttctagggtgtcctctctttgcatgtctactgactcccagtcatgtcatcttgtcactggaatcagtgtcaacacctacagcccccagactacaaagaaaaccatctgcccagtaatagcgatcccagcccatccctcatatcagaatttcaggagaaaagcagacaaccactaatccatttccttttgtcttccctttcccccacctctagacttactacttacctgagccaagtatgcaccataaccagtggccagcgaaggggcttcataggctacaccaagcatgtccacataaccgaggaagctaacaggacacaatgggtcaaaactcatttcaccttaggttcatcttagctgaagaaggggaccatggggtctgagttaaagtgggattcacttggggagaagagacagaagagatactacacaggtactaggttgggtggtaaaggaaataagttatttgtattcatatgaacctctctccatcagcatagcctccgatgaccatggtgttccacaaagggttcatcttcgagcgccggctgtacatggccctggtcagccatgaatgaatagctctaggactatagctgtgtccatctcccagaagctcctcatcaatccttaaaaggaattggttgtgagaaaagggagagaattaagtcggggtctccacccatccccaaaagaagttaccacaccttcccccattttacacctaatgccaaaaactttattgcaaacacagatcgcccacctccaacaactctcccagtcccccgctgcaacaagtccccccatcccatcgaagggaataaaaaacaggggactcccctctctacttgggaaccactctcctgttctctggatgacttacaccatctggccgagaacttgcttcaaatactggaaatcagcgtagtcgccagaggcacccagcatggtactgttgttgactcgcataatgcgagagatgttgcggaaacgagccaaggagccgtaggatcccagcatgtctgcggcaatcaccactccgccctcgaacttaacgccgaggactgaggtcccggtcaccatggggttcctaaagagtgagaacggtgggagctgagaggggggatggactgcgccctctttccgcgcactgagctgcgcttctgattttctataattccttccaattattctgcattctccaggactccgcgccctgagctcccctgccgttcgcgcgcccccggggtccccgcctcaccttcccgggctctcaaaaccagccggcagcaccaggccccacggtccctcccgctacgcaaacgaaagcgccgagaacttactgggtccgcgtgattggacctctgtaaagtgcagacgccggatccatgaaggaatcgggagtggacggaatgcggtaaaactgtcctggggccggaccccccgcccaaagtccggaccgcgaccccaaaaacgcttccatcttagtcacggtagcagaaaaaatgaaag

SEQ ID NO: 15094 - DNA, 334 bp, Homo sapiens
tggctcatacctgtaattctggtactttgggaggctgagatgggaggattgcttgagcttgggaggtcagggttgcagtgagccatgattgagccactgcgctctagcgtgcgagacagaacgagactctgtctcaaaacaaaaatccagggttctcggtagttaaaaaaagaaaaaagaattatttcaactttattcatatttctttggctggggtgtagggggctgggggcggggggaggttagacattgtccagtaaatgcccaaggctttaagcttccagttttcatatttgcaaaaacttgaaactaattccattaaagtgacaaaaat

SEQ ID NO: 15095 - DNA, 1035 bp, Homo sapiens
gccagaaccttcctcttttttcttaaaaactcttcttaattgaatccaaagtatcttttaaatgttctacttgtgtaatcatgtcatctgtgaatattcagatttatcttctccttccaatccgtgtacatttaatctctttttctgtgccttatttcgggggctgggacccttcagtccagtgttgaagagaggcagccagtggaggtcttgtctcattcaaggactcagagcaaatgtgttccacatttaatttcactatgaaatataatatttgatgttcagttttgtagatgctatttatcagatcaaggaaagcccagtctatacctaatttgttaagggttttgctttttatcataagtgtcgacttttatcaaattcttttttgtatctattaagatgatagatgattgattttcatatgttaaattaaccatgggttaaacaaacttacctttatcatgatatattattctttttgtatttcacaggaattagtttggtaatatgttgggtcaatgtttaaaaaagaaaatgatgtgtaatttttttcttttattgtagtatttctgtttaatttttggtatgaggattattcaggtctcataagagttaggagtatattctcttttaaaaaatatttgctaatttacactcccaccaacagtgtaaaagtgttcttatttctccacatcctctccagcatctgttgtttcctgactttttaataatcgccattctaactggcatgagatgatatctcattgtggttttgatttgcatttctctaatgaccagtgatgatgaactttttttcatatgtttgttggctgcataaatgtcttcttttgagaagtgtctgttcatatccttcacccactttttgatggggttgtttgcttttaccttgtaaatttgtttaagttccttgtagattctggacattagccctttgtcagatggatagattgcaaaaattttctcccatcccgtaggttgcctgttcactctgatgacctatcaatgatagac

SEQ ID NO: 15096 - DNA, 9357 bp, Homo sapiens
agcattcccttcgtgccgctaccaagatggcggcgcccatcttgcggtccttttcctggggccggtggtctggtaccctaaatctctcagtattgttgcccttggggctgcgtaaggcccactcgggcgctcaggggttactggcagcgcagaaggctcgaggtctgttcaaggacttcttcccggagacggggacgaaaatagagctcccagagctcttcgaccgtggcacggcgagttttccccaaaccatttactgtggcttcgaccccacggcagactcgcttcatgtgggtcatctacttgcgctgctgggcctgtttcatttgcagcgagcgggccacaacgtgatcgcgctggtgggaggcgccacggcgcgcctgggagacccgagcggccgtaccaaggaacgcgaggcgctggagacagagcgcgtgcgagccaacgcgcgagctctgcgcctagggcttgaggccctggcggctaatcaccagcagcttttcactgatgggcgctcctggggcagcttcactgtgctggacaactcggcctggtaccagaagcagcacctggtggacttcctggcggcagtggggggtcacttccgcatggggacgctgctgagccggcagagcgtgcagctgcggctcaagagccccgagggcatgagcttggccgagttcttttaccaggtgctccaggcctatgacttctattacctcttccagcgttatggatgcagggtccagctgggcggatctgatcaactaggcaacatcatgtccggatatgagttcatcaacaagtaagtgcctttaaaccttggggaaatcctgggaccaaataatttacacactagtagcctgtgattcactcttaggattgtagttgctgcccttcgttccagctcttgttggttttatccccattaaggctctataatggcgttaataacactggctaataagaattaaagggctgaattaagggtattaagagtaaacggtgtattctaaaaattagctgggcgtggtgatgcacgcctgtaatcccagctattcgggaggctgaggcaggagaatctcttgaacccgggaggcgaaggtttcagtgagccgagatcgcgccactgcactccagcctggggcaacagagggagactccgtctcaaaaaaaaaaaaaaaaaaaagggaaacagaccactagtgaagatttggtcggtctgttttgcttcgcctaagtcgtcctctctaattagagaaactgcttttgtgtgtttataccagaacgtgactgggcctccttgagtagctagcctctgctttagctctgcaccctccatgaaactagtgttagtccttggttggtatctcaaaaagttttttcaactccaaataattgacaagtaatgcgggtctaatagcattttcttgagagaggtgaaggatagggctagctcatgtgcaacagagcaaagcacatgtttaaaaggcgtttagaagatttcctttagtgtctcttcctgacaccccttcacccagttttctccttcccactcagcctttcaaaatctctagtccattgttatgtagcacttccccttggcctgcctagaacctgcctggaaccactcatgaggttcagaatgaatagagtaagtactgtaacaatacataagaggaacaagaattcagatttaggaggtcaaggaagttttcctggagcaagtaaccagaaagaaatctggaaggtgaacagtagaacctaccaccacttgtgcttgaggcacataatgaaattgttctttatgcgtaggttgactggagaagatgtatttggaatcaccgttcctctaattacaagtacaactggagcaaagctgggaaagtctgctggcaacgctgtttggctaaacagagataagacatctccatttgaattgtatcaattctttgtcaggcaaccggacgattcagtggaaaggtgagttctgaataatgggctgagaaaaactgacaccataaactcatgatgtaattttagccattgaatctatgtacattttatagtttttttgtttttaacgtagtttctgtctgtacataaaccattacatcatagaagactaatttttactgtgttctaaagttaaacactttgttggttaaagcagaaaaacagtgggtggctagaaaatgtagagccaactttttgatctgtatctagcaagttcttaggattttatcacctgcatattctagttttttcactcctttcaacttaaccttgactacccttatttttcctttgtctctcttctctcacaaatatgactttaaagatcctcttaagaaatgatttctccttaaatcaaattgccttaaactcttggaagaatatgaattaatgagaaacaaatatacctgcaacaaaaagtgaaaaaaatattttgatgctctgtaacatcaaagtaatctaggaataattctttaagacttaaaaggtatatgactttcctgcaaaatattaaaagatgctattgagcaaaataaagacctacataaatggagagttagaccatattcatagtacaaaaataatatcagttcttttttgtattttttgaaacagaatctcactcccattgcccaggctagagtgtagtgacgcagtcttggctcactgtagcctgaaattcccaggctcaggtgcacaccaccatgcccagctaattttgtattttttttttagtaatggtggagtttcaccttgttccccaggctggtctcagactcctggactcaagcgataaacctgcctcagactcccaaagtgctgggattacagcatgagcccccgcacccggccaagataccagttctggatttgatctacatttagtacagtgccaaccatatctaaaccggctttttgtggaacttgacaagctcattgtaacactgacatagaaataaaaagggctaagattggccaagatgtttttgaagaacagagtggaagattatcatgccttattacaaaattttggtaattgtgtttttttctctttagatttagtcctagaatgtttgacgatatagtcctggggttttgatgtattgagaattgataatctttttttttttttttttttttttttgaggcagtgtctcactttgttgcccaggctagagtgtagtggcatgatcttggctcattgcaacctccgcctcctgggttcaagtgattctcctgagtagctaggactacaggcatgcgccaccatgcccagctaatttttgtatttttgtagaggcagggtttcgccatgttggccaggctggtctcgaactcctgacctcaagtgatccaccttcctcagcctcccaaagtgctgggattacaggcttgagctaccgcacccggcctagagaatttagataatcttttcaaaaattgcattttctatctggttctggtgtatagaaatacaattactttatatatattacctttaaatctagcaactctgccaaactcactatttgattacagacgtgagccactgcgcccggcccaatactgtatttcttgaccatggtgatggttacatagatgttttatgattcattaagctatatctttgtgaataatgtacttttttctgtgtgttatatatatttcaccaaagaaaaagagaatacatataggatgatattatagtcatatatcacttaacaatagggatacattctgggaagtgtgttgttaggtgatttcatcattgcaaatatcgtagagtgtccctgcacaaacatagatagcatagcctactacacacttaggctatacagtgtaccctgttgctcccagggtagaagcacatacagcacattactgtactaaatactgaaggcagtgataacgcgagggtaagtatttgtatacgtaaacatagaaaaagtacagtaaactatggtattataatgttatgaaccactgttggactgtaccagtccgtggcctgttaggaacagggctgcgcaacaggagctgagtggcaggcgagcgagcattacacctgggctccatctcctgtcagatccacggttgcattagattctcataggagcacaaaccctattgtgaactgcgcatgcaagagatctaggttgcgcattccttttgaggatccaacaaatgcctgatgatctgaagtggaacagtttcattctgaaaccacctcccctccccgccgcctcgtggtgccaaaaaggttggggaccgcggatatatgtagtccatcattgacagaaacatcattatgcagagcatgatgatttatatcagtttttaaaattacacagtactttttttttatggccacatgcacatgaaagtataaaaacatgcttgggaaagatggcagcacataaacttagatttatgattatctcggggcaaggaagggaatgtgattggactgcggccttcatctatgcctattttgttccttttaaaaagaaaatacgaggctgggcttggtggctcctgcccataatcccaacactttgggaggctgagacaagaggatcacttgagcccaggagtttgagaccagcctgggcaacacaggagaccccgtctttacaaaaaaaatataaaaattagccaggcgtggtggcacaagcctgtggtcccggctgcttgggaggcagaggtggtagaattgcttgagcccaggaggttgaggttacagtgagccatgatcatgccactgcactccagcctgggcaacagcaagacccccatctcaaaaaaaaaaaaaagaaattgaaaacaaagatgccaaaatagtaacaccttaaatctgggtgatgtgtgcatgggacctactatgttcagtacatttctgtatgtttgtttcatatttaaaagtaagcaggataaccttaaagggtagaagagctggagataaaaattaggtatgttatataagtgtaactctttattttttgtctcaaaggtacctgaagctgttcactttcctgccccttccagagattgatcatatcatgcagctgcatgtcaaagagccagaaaggcggggtcctcagaaacgactggcagcagaagtaacaaagcttgttcatggacgagaaggattggattctgctaaaaggtagtagtttagtatgattaacacttgatagttagttattcagtggatagacatgagaaaagtaggagtatgttttaggattatcttgtcatttatcacaaggactgtcagtatttgacttagcaatttaaaatagcccctgtttattggaaagaaggattatcttgaattaagtttatgaattataccagatagatgtttaaaaaacttttagtctatgccgggcgcggtggctcacgcctgtaatcccagcactttgggaggccaaggtgggctgatcacgaggtcaggagttcgagaccagcctgaccaacatggtgaaacccccatctctactaaaaatacaaaacttagctgggcgtggtggcacacgtctgtaatcccagctactcaggaggctgaggcaggagaatcgcctgaacccgggaggcagaggttgctgtgagccgagatcatgccattgcaatccagccggggcaacagagcgagactccatctcaaaaaaaaacttttagtctagaacttggacactctataattggttaatgggtattagaacatgtatttgaataaacatttatatgatgtagctcttaaaatgtgtttttcaggtgtacacaagccctttatcacagtagcatagatgcactggaggtcatgtctgatcaggagttaaaagagttgtttaaagaagctccattttctgaattttttctcgatcctggaacaagtgtcctagatacttgccgcaaagcaaatgccattccagatggtccccgagggtaagattatttaacttttagatttacagttaattcaccattaaatgttacagttcacaaggccaggagaagtggctcatgcctgtaatcacagcacattgggaggccgaggcgggcagatcacgaggtcaggagatcgagaccatcctggctaacacggtgaaaccctgtctctactaaaaatacaaattagccgggcatggtggcaggcgcctgtagtcccagctacttgggaggctgaggcaggagaatggcatcaacccgggaggcagagcttgcagtgagcggagatcccaccactgcactccagcctgggtgacagagcaagactctgtctcaaaaaataaataaaatgttacagttcacagcatgtgtttccagagaggatgttttcctgatagtgctttagtggcatctcttccttagaaaagttagtttagtccaagaataaagtatagcctgagagtacttattgttgaaaatactttatattttctataatagtacagtactcctatactgtctcttattatatctaacccagtcagtctttcctccaacactggaaaagtgcatttgagggacatgttcagtaaatacactggcatcagtgtacggcttagggatatggtcacagttttagagggatgcagaaacagaggccctatgtaacagattaacacagcccctctcatagtctgtatcctttttatattcggggatgggaaaggttacctaacctatctatagtattaactgaatttctgaaaatgaaatgagcatataatggccaaaaccgcaagtacttttgcactaacctactaacgtcataagactattattgtaaactatataataatccccttgagaattgcattttctattcaggaattgagtagaatattttaattaatcagttatgaggtattaaggagtaaataaggtttttcacaaaaaataattcagcatataattgatgcttatccatttttaaatgaacagtgaggtggaaggaaaagtgttgggtagccagaagacccccaggtgcctcttttgcaggagttcacacagaagtcaaatggttatcggccatatcatggccatgattatgaatgacatttgttatagttgttctctttcaactgtcttggattgtttgcctgtgtcctaaagagtcctagactattctgcctggaaaaagcacccattgtctccctttgcatcacctgccactccaccttagtgattccctcatctgctggtttaacacacagtgaatttgaggctggtgtcatatacttccctgtagtatgtcagcgagacaaataattttcctcactatggaagcagatttcgttttcttctgaactttactatagtgtgttcgctaatactggaagctttaccactactaaaaatgacaccacatctgatttagccagggctctaagtaatactgatttttttttttaatattatataagctaaataggtttggtgcatttaaattaaacatagaacatgatctggaaactagcagacagcgtaaaataatacttcctaaaagaaaggaatctggccttaagtagaaaatattttactgatgagttttataaaaccatgtccatggccaggtatggtggctcacatttgtaatcccagcacttcgggaggctgagggcgggaggattgcttggggccaggagttcaagatctgtgtgggcaaggacgtagtgagactccgtctctacccaaaaataaaggtataaaaatatctttaaaaccatgtccagtagtggtttcttaattttatttggtaacattcagatgagagaaaaccaccatttttctttcttaaggacttccaagatctagccacgctgtagccctgtcttctcagatctcacctctttctagctgctcccatgtttcctgccctgattgtcaaggtagcttcactcccagtttaagtatctcttttttcagtgaaatgttcagccctcacctacccagtgtgctcctagaacaacttctcctaggtctttctttttttttcttgagacggagtctttaaaagagcagattgcaaggcgtaaattccggccagacacagtggttcacacctgtaatcccagcactttgggaggccaaggcaggtggatcacttgaggttgggagtttgagaccagcctggctaacatggcgaaacccatctctactaaaaatacaaaattagccaggtgtggtggcatgcacctgtaatcgcagctactctggaggctgaggcaggagaatcacttagaacacaggaggcggaggttgcagtgagctgagatcatgccagcctgggctacagagcaagaatgtgtttcaaaaacaaacaacaaaaaacaaagagcagtaaagagaggcagaatctattaataatagagcaaacatgaaggtaacagtccagtgccaaatgaaatcttctcaattggagagcctctgaaatctaagtgaaacagtcttttttgggggacagatcaacagtgattggatctctctacttactaaacgtttctattttttaggtatcgaatgataacagaaggcggagtcagcataaatcaccaacaagtaacaaatcctgagagtgttttaattgttggacaacatattctcaagaatggactttccttacttaaaataggaaaaagaaatttctacattataaaatggcttcagttgtgatgaaaagtccttctggttgtccaaataaacttacccatcattcattctcaagacctctgaagggttggctccagaacttagacctttgcttatgcaaatcagaaaaacagaatggactaggactcagtgtgagtaacttcattatttttatgggccggttaataaatatttgtttaataatgggatgttttattttctgatgtacaaagcttgattaccatagaaaaccatgattttcagggttaatctctttttaaaattatacttcagaagagaaagaaatgctgctttcctatcttacccttcctgctctcctttttgtagtgatgaggaacaatgaaaaagaggtagtgtaaggaattgtgaggctgggcatggtggctcacacctgtaatcccagcacttcgggaggccaaggtgggcaaatcgcttgaggccaggagtttgagaccagcctggccaacagggcgaaaccccgtctctactgaaaatataaaaattagccagatgtggttgcaggcacctgtaaccccagctactcaagaggctgagctgcgagaatcacttgaacccaggagatggaggttgcagtgagctgagatcacgccactgcactccagcctgggagacagcatgagtagtgagtgaaactctgtctca

SEQ ID NO: 15097 - DNA, 422 bp, Homo sapiens
ttgatgcatgtactttattgcactgagtttttcttgctataccttggacaagactgccacctcctggaagagccgatgaatactggggacgaggtgcaattagggaatcggtactatgaaattgcttgcgtctcagcagcaactccctatctctccgcgaacttaaaccaattcctaacctttctcaacctctgtgaacagctttttgcatggaaccaagacttcaaagaacttgcgcatcacaatctttttacgtgaaaatgtaaatacaagttagcatttgtgaagcgttatgtgccaaatgctttaatttttaaggctcacaacagccttatgaggtaggaactatcataagcagatccacactgctgatggaaaaattaagtttaagggaacgtaaggcgacggctctgaggcggaat

SEQ ID NO: 15098 - DNA, 9357 bp, Homo sapiens; identical to SEQ ID NO: 15096

SEQ ID NO: 15099 - DNA, 422 bp, Homo sapiens; identical to SEQ ID NO: 15097

SEQ ID NO: 15100 - DNA, 25231 bp, Homo sapiens
gaagtatcatgtaaaagaccagaaaaccatattggacaaaaagaagctcatagcattctggttggaacgttatgctaagagggaaaatgggaaacctgtaacagtgatgtttgacctgtcagaaactggaataaatagcattgtaagcattttttcattcattccaaatcagtgtttatcatggcttcctccctttctcctgtccttgctgccaaccacatattgctgtaaaattgaggtaactaacttatattagggatttattttttcaccttgcagtgtgagtgtagtcaaacatggaatagggtttgcagagaattaaatttgtttctgtatttggcgttgaaactgtcgatttcctagaaatgttccttgtctgagacacaggatggagaggtagcatgtcgaggctggcaaggtatgaatcgatgtgataactgtgaactttgatatcaaagctaatatcctatagcacctgccccggtgtgtgccacatagtaatatattcaggaaatatcaagtaaggtaatataccatctcgaatttgttatattcataccatgttttacagttgcaagatgttcacatgagttttgcacatataacactttgtgattttattgagtgtttttgtttgcttgtttggatttgttttctatctgtttgatttggttagctttggaaaccagttttcttcaggtgattttgccaagcttgaaaaataagtaaaacctacctgtctttaatttgggtccttgtgaccttagtgatacctacaaacccttcagcagcaattgagatcacttggcacatttattctaactactgtctcttatatttaatctgtggctaattctgatagcagtaatgtcgtattcacaaacgtgctcagggcagtgttgaaatctttttggaattccatttggcaaattatgttaagaaccttaaagtgtttgtatttatattctttgcctggtaaccaacttctggaaatctattctaaagaaataatcctgagtacagaaaaagcatcatacatcaaaatattttcccagtgtcatttaaagtaatgaaaaattagaaaaaaatataaatgttcaacatgatgaaatggcaaattatggtatatctagttagttgatggagtatacatatagctatgtaaaatggtgtttttaaggaatttatagtaatattggagagaacacttttttctgagatgaaaaaagctgtatgattatacatactataatatgtatgtattctataccatggtgatacatagcccaacaaaggaaactgtagacataacacaaaaccagctagagagaactgctaacaagagctttcttgcagtggtaggaccacaaatttttttcatgtttctatttctctttttatttttcaaggatccgatgccctggagttttccaacctagtttccatgtcagtggttttaaattagagaaagtaaattattttatatccaaaatcaaaatcaatttgcctagataaataaatattccataaaaataaatcctgattcttttgtcctttggatatgatagtttcctaattattaacccagaatcatgaagaataaatgttaatatttttgttgccaagtataaggacagagaattgacttgaactgttttattttttcaagctacttatatctcaccatctttaatttgtaaataaggtgtatttgcactactaagtatttaagtcattattgttttaaaatacttgaatcttactgaataatttattttcataaatgaccctttcatgagtcacaaagaatttaagtgagcttataaacatgtcacaaagaatttaggtgagcttataaatttcaaggcaaaaaataagaaaatcatttgttagagttgggacaccagtttggctctaagctttcagctgcctgcctgaaagaaatgcaatcatttaaaattattcagcggccatccttcacaaccagtgtcttagaagtatatccattcctaatacttgaactagaaagtctttcatgggtcctcaaaaggacgttttacaagataataacagcctcctcgaaaacatccttatagaatgctgagcaatagggttgatggagctatttcttgtagtccccattaatagaatacaccagtgacatcttatcatatccacttgaattagcagtaactcacgattttacgaagaaggatattcaattaaataaatgatagaaacaagaatgttattccaagactatttagacaaagtctctgggggccataaattctagactaggtaaccacatttttatataactggttcttttcagctattttctttgactgttacttaactgccaattatgaaaactccatgcacagtggctataatgattagttacaaaggtattattatatatatatatacacacaaaggtattttatatatatatattatatacatacacacacacacacacacacacacacacacacacacacacaaaggtattattatatatatacccataacaaatacttaagatagttaaggatgcttacttttagtttactgcaattaaagatgctgcaactaacattccagggatgaatttatagacacttatctctaggaaaacccacctttccagtaattgtgatggatttcagtttgcttggttgtatctttcatcccacagtctttataagatggccaatcagaattagtgaatcagtatgtggccatggagtgaaatgactcatggaaataaccttaatgacctaatttcctgttgctgtgctcaaagcagtagaaccaaccagatagctatgtttgtagtctcccagaaatcagaatcagtgaacaacactggaatataaactaaaaaactaattctaggtctctaaataaaatttaaaaagccagaaatggagtagatacagcaggccaatgtgattagattaagtattgtgtttaaaaaaggttgataaaatatattttattgacactattatgtggtgtaaaaattaggattaaaaagcaaatatatgagaatttacatacatgtgtattattatcccaagtagtctgattataaactgtatacttgtttcaataattctttagttattcaacagatttttagaatttctctatggagattgcttttagatccattttatgccctgttgccttagtagcctgaagtgtgtaactagtttgaggtaatgtgaataattttaaaacatcactaagcatctggtttcttcaagtcagttttagggctgattattataaatagcttaatgacctaaaaccttaatccttgagaatatagatatttacatatgagcttactttttaaagaatttaataattgtctcacttgtatttaataatttatcacctttagaaatgtgcaattttaagttctctaatgtggacagtcttaaagatttaatctttattttaggacatggactttgtacgctttatcatcaactgctttaaggtttattaccctaaatacctctgtaagtaacttactcctttataaaaaatataacatattgaaactgtagacaatgtctgagaattgtggagccttatgttattatagactttcatacctgaaactttgttttctgatgaagaattttaaatgtgttcatagacattattgtaacacatacagaggaaagtttttcataagtattcattgtccttcacagttaattttaagagtttaagttctaaactatatatatggcatcctataacacacacacccactcacacacataggtacataaaagcatacatttatttcaaaattatctcatttttactaatatttcaatttagaaattcatttcaaatagtatttattatatgaaacttcttgcatacaagaacagataagcagtattgatagagtacactgtataataagcaatattgatatataaagtacactgttaccaactgctacttaaaaattgtcattaagaaaatacttgactagaaggtactacatttgaatctggcatttggagtttgtttgttttttattgtgactattccattaattacctgaatgaagaactcctaaaccttatatagtccattttttacttgttgaatttgtatgatgggttcaccctagggaagccgagatgccaactcacataaacagtcaagtatatttaaccccaatggtttaaaagtgaaaagacagcagagaggcaacagggatgtcagaaaatgggaatttacagatctgcctgagcgtactcctagaaaacagcaaattgggtcttttgggactcgtgactcaggtgactttagcataaaatccctaaattatcttaatttggcatgttaattttattgttaatgtgaagtgaggaatagacaaaaagcataatggatatcaagagtcagtgccacccctagctgtatactctcatcttttcagagagagtattcatgaatatttttaggtaaaaagaatgatcaatagtgtccagtttggggaacctgtactatcttctgttccttatggatttttcctgtatctggcatgtaccctgattccttaaggcctccagagcagtgccagtcattggtcagtagggaatcactaccccatagttttagtttgttgctcttatggacaaaatgaaaaaatatccacttgatcattgaaatatctaaaggagtttgtgaagagccacttatcagtagtataaatattattattactttgtaaaatacatctgagattcttttgagagaactattaaaaagttaatagatctatataaagatgagttgtaatactattcatcttaactagagattttatatatatatatatacacacacacatatatatatattctacctacataatatagttttgcagacattgaatttcgtggaatcttaattgattatgcttcaaaatctgtcatgaagaataactattatatcttaaaatcttgagtccacattattttaagcatatcccagacgaagactgaggtattaagcaccagggtgcctctttacagatgcctttttccttatatgtactttacttgtcctacattaatgcaacaactctaagaggttctctgctcagagaagagtgaaattacattttgattcctctggaatagaggaatgaattgaatctcaaaaatcttctttgcagtttctggttctttctcacagttgtctcagttgttaatagggctgtttagtatcttcaactcagtgtgtaaataatacttatgcatactttggaattattagcttcctggagctcatgatataaagtagaaataatttttgtttctgaaaacgtagtgatgtattaaaaggggagggggcaactgtgagactggtttaacaatagaatctctagaaaattgtaattgaaaccataaattagacctggaaatgattttaaagttcagtggcttcagcactactttgacatgccacatccaaaaactccatttatccacttaactgttttcttttgtacctccctgcaaacaacaaaagcagtgagtgacaaaagaataggctgtttaccagaggacagtgacagtgcactattgatttcccacaagtcttcctcctgggctggcacctcaccattgtgacatgctagttcagttccagcaccacatggaatactattcatgatactatacacttcactgaattagagctcagacaacaagctcagtttttacttaaatttagatgaccagttttttctaggctggtatgagtgatattattatagaggtactgattcacattcaatgaattttttttcatctttcagcaaaaatagtgatctttgatatgccttggttaatgaatggtgagtatatttatactttcttaaaacaaaatgtctaatttcctttactttgccgatttagccatatttctacaattgtttaaaataatgtttatattgtcctttgcatgctctcttaagagactggagctagaacactcaaaggctattcctaagcaaacagggctaaaattttatacccaggatctgggggcacccattagtcttctttaaaaacagccttgccaggcatggtgttgcacggctatagtcctagctactcaggaggctgaggcaggaggatcacttgaacccatgagtttgaggccagcctgggcaacataatgatacccatctcttaaaaaaaaaaaaaaattaacaacagcctcaaatattcaaccattaaggtaatactctagtcagaagcctcaatttgtcatgcacagataaggtatgtcacagaacacaggccttgtctaggtttctcatgggcttcaggtgttgagaaagaaggtggaatcagtctgaaactcaccccaaatcactgtagtgacatgacccttttgacagtcatgatatattttttggtaaaatttttttgaaaaagccattgattgataaactgtcttgaccaactttaaaattactgtaaattgaatgttattttcagaatgtacattctcatttgtgtttgcaaaagtcagttgttacatagaaagcaatagagaaaatcaacaaatccaaaatttggttctttggaaaatgcaacacaattgacaaacctttagctaataaagaagaaaaggaaagactcaaagtattaaaatctgtaatgaaagaagggacattactattgaccttaaagaaataaaaaggactatagggagatactgtgaatgattatatgcaaagaaattagataacctacatgaagtgaacaaattcttagaaagacacaaactactgaaactaattcaagaagaatcagaatagaaatataaaaaaggaagttgaattagtaatcaaaaaaaacttcccacgaagaaaagcccaggcccagatggcttcactggtaaattatgtgaaatatttaaagaagaatcaacatgaatccttcacaaattcttccaagaaatagaagaagagggaatactttccaacttattttatgaggcaagtataaccataataccaaacatcacaggaaaagaaaactacagactggtattccttatgaaaatagatgcaacagccctcaacgaagtactagcaaattgaatccagcagcatataaaaaggattatacaccatgaccaagtgggctcaacatatgaaaatcaactaatgtaatctaccatattaatataatgaaggggaaaattatgtgatcatctcaagagacacagaaaaagcatttgacaaaatctagtaccttctcatgataaaagtactcaacaaactagcaacgtaaggtgcaaagagttgaaacaactaccaagttagaccacagtagtccacacaagaccacccccatttctgacacaaactgcaagttcaggaggtgctcaaaattgcccttaggtttgataagtctagtgaaggactctgagaactcactgaaaactattatactcacaattatggtttattacagggaaagaatttagattaaggtcaaccacagaaagtaaggtgtagggcagagtccaaggaagtaccaaatgttgagcatattacttcactggcatcaatgtgtggcaatgtgcatggagttagtcaacctgggaagctcacccaagcctcagtgttcagagtttttattggaactccattatgtaagcatgattgattgcccatgtggttgatcttagtcttcagtctcccccaaggtctactgatactgtgtaacccaaacgcctaccctgaatcacactgttggtctttcttctatggccagttcctaccctaagtcatattgtcccattgtcacttaaggcccccagacaaacaaagacaatcctatcaggcatgaagattacctctcagaagctgagggcaaagtgcagatctctctttgggtaaggctaatccttcacagaaaagaacttcctccacctgtttataaagggcatatatgaaaaacctgaatctatgaaaacccacagctaacatcttacttagcagggaaagaatggatgcttcccccctaagatcagtaacaagacaacactgtctctcttaccacttctattaataaaagaagttcaagacaaggacacggaaaattacaaaaccccattttagtaaattcaagccttacataaatgaaaagacatgttgttcatggattggaagacttaatacagtctttcttcagtatccatgggggactggttccagaacccctcccccaccaccaccacagactccaaaatccttggatgctcaagtccctcatataaaatcgtatagtatttgcatgtaactgacacacgtcttcctgtatacctttttttttgtttgttttttgagatgagtctcattctgtcacctaggctggagtacattatcacaatctcagctcactgcatcctctgcctcccaggttcaaacgattctcctgcctcagcctcccaagtagctgggactataggcacctaccaccacacctggctaatttttatatttttagtagacacaaggtttcaccacatttgccaggctggtctagtcttgaacctcaagtgctctgcctgccccgccctcccaaagtgctaggattacaggcataagtcatcatacctggcccctcctatatactttaaatcatctttagattatttataatacctaacacagtgtgagtgctatatagttgttctactctattgtttcttatttatatttttgtcgtattggttttatttattttttaatattttcaattgtggttggtgaatcaaaaatccatggatgtgaaacctgtggatatggagggccgactgtattgttaagaggtcaacacttcccaaattgatctactgattcagtgcagtccctatcaaaagcccagctgccttttttgcagaaatggatatgtttgtcccaaaattcatatgaaaatgcaagaaaccaagagtagtcaaatcttgaaatagaaacacagagttggaggacttaacacttcctgatttcaaaatttactacaaagctacagcaatcaagacattgggcatgtatgggcataaggataaacgtatagatcagtgaaatcgaattgagggtccagatataaaccctaatgtttattatggtcagttgatttttttttacaatggtgccaagactattcagtagagaaataaggctttttaaataaaaggtgctaggacaactgggtatccacattcaaaggaatgaagttggaccccaccttacatcatatataaaaattaattcaaaatgaatcagaaacctaaatgtaagagctaaatctcttagaagaaacacaggattaaatccttgtgcttggattgggcaatggtttcttagatatgacaacaaaagcacaagcaacaaaataaacagataacattggactgcattaaaattgaaaacttgtgccttcaaggacactaccaagtaggtgaaaagacaattctcagaatggaagaaatcatttacaaaccatacattttataagggacttattctagaatatataaagaactcttacaatgcaatgttaaaaagacaagtggctgggcatggtgactcacgcctgtaatcctagcactttgggaggccgaggtgggcagatcacctgaggtcagaagttggagaccaacctggctaacatggtaaaaccccatcttgactaaaaatagaaaattagccaagcatggtggcacacgcctgtaatcccagctacttgggaagctgaggcaggagaatcgcttgaacccaggaggcagaggttgcagtgagccaagattgcgccattgctctccaacctgggcaacaagagtgaaactctgtctcaaaaaaaaacaagtaacccaattaaacgagtgaaatatttgaatagatgtttttctaaagaagataaacaaatgggcaataagcacataaagagatgctgagcatcagtagtcattagagaaatgcaagtcaaaaccaagtgaggtgtgatttcacacctactagggtggctagaataaaaaagacataataacaggtattggcaaggatatggagacattggaagcctcatacactgctggtgagaatgttaagatggtctggccacatcagaaaacagttcggtagctaaacatagaattaccatatgacccaaaattccactccttagtatatgcccaagagaagtgacaacgtatgtctacagaaaaacttgtacacaaatgttcatggcagcattattcataataacaaaaagtggaaacagcctaaatattcatcagttgctgaatggaaaagcaaatattgcatatctataaaatggacaattattcagtcataaaagggaattaagtactgatacatgctacattatgaatgaaacttgaaaatgtgccaagtgaacaaagccagtagaaaaagccatgttgtatggtttcatttatataaaatgtccaaaataagcaaatccatgaagacagaaaatagattagtagttgctaaggacttggagaaggaggcctaaagagagattgctatatgaaggttctttttggtgtgatgaaaatgttctagattagattgtggtggtggtgatggtggttgcacaattctgtgaatatactaacaaccattgacttgtataaaggggggattttatggcatgtaaattatatctcaataaagttatgaaaaatcagatttatcagattaaagtagcatagtttcaaacatgtcaactcacattttaaattgaaattaatgaaaatttaaatgttatgtaaaaaacttatagttagctaaaataaaaagatacttctccgaaccatttaatgtttatcatactgttcttagtttctgtttttttaattgacagttttgcaaatttaatgcagtatttctcttttaatttcttaaaaatgtacttagattgtcacagtgaaaatgaggtttaaaaattaagcataaataagaaatgacatgacagaacaagattgtaattaccaaacagctgtgtttgataacagaacagggcagttcgtgccactgcactccagcctgggtgacagagtgagactctgtctcaaaaaaaatttaaaaaccagtttatttttgagatttcgtaagtttcccacaattatataaactgcaaggcctgggagagaggcagagaagtgtagggttagaaaggaaggctggatccagctcacactcataataagaagggctatttctttctttcttttctgactcgctgtttgagaaggtttttcagatagagagtttatcagaaccataaggtaaatgactctttccatactattgtgcagttatttcctgaatcatattgctgtttgattcagtgtctggaaatctaaatagttgggatcattgatggatttgttcagaggccaaaaccctgataagtttattaatgaacatcagggtaatttaatcttcctgaatcttcatggaacatttgaaacccataagggagagccacaatgtaaacgcctacagaaattagagaatgttaattaagtacatcacgtaaagataaatattaacagattatagcccaaactgatttcagaagacctgggttagcatttatggtaaattaattgagactaggaatgatgagaattttaatgaagtgactggtttttcttcagctgctttcaaaattgtgaaaacctggcttggtccagaagcagtgagcttgttgaagtttacaagcaaaaatgaagtccaggactatgtcagtgtagaatacctgcctccccacatgggtggaactgtaagtatttgaaacttgtttataaaacaatactggataatggcacattaggctgtatactttcctcaagggaaaaagaaaagtagtaccataatatgcaaagaaatatcacagatacccccaaaatagcaagtagtgttacacacatttttaaagttttaaagttaattttttattttttaataggtaatatatttatgtggttctaaactgaagagtattcagaagaataatgagaaataagtcttcagtaaaaatatcacctcctacttctgtttccaaccaccatattccctccccagctgaatttcttgtattaatttgcagggatatgtattacccatataaacaagtatagtatataatttttcctccctctcatctcttctaaagtcagtgtatttatgtgctagtgtgcatcctgcttttctcttcacagtacgtcttattccaaatcaatatgtagcaggctctcatactcatttatggctgcatagtattctactatctagacataagttagtgaatttcctcttgatgtgtctttagtgtgcttccaattgtttgctgttcaacagtctttttagttaaaaagatactattaagcatatactatccagatttttttgagctgatttttactacttataaaaaaactgtacaacttatggacttggtacgctttgggttaacttcataatgtttcacttatttgatttttttgcaatctattttttatactgcctgcctggcaaaattgtattcaatcagaactagcaagaggaatagtttcgatatgtccttctgtttattgtctttgattagaaaagacctgaacaaatatttttaatttgaagtctgcttctttcttattctaaggctttatatttcacattttcacctagaaaaaccaaatatacttcatttcaggtgctatgcttgatttaaaatgtgattttatttatttttaataatttgctcataaaattgttatatcttaaataattataattaatataattcataacattttaaataatgttaattttatgtatagaaacggttattttatttcccctctctgtccttagtgatatgtttcttcagaattacagtcaaaattatagtaggactactattttttaacattaatttttaagtattttttttcaaaaaataatacatatacatgattttttaataaagtaaatacaataccagagattgaaaagtataacagtaccatgaaaactacatctgccttcccaggtccatgcccactgccactccctaaaggcagtcaccatcaagttttctatccctctggagttatctattacagttttttacacaatggtcacataccatatatattgtccatttgtacttttttcacatcttttattttgcaggttacaccatattgattcacagaggtctatctcatttttaaaccaaaatattccactgtatggacgggtataacataattgatttaatcactcttcttttaaagggctgcactgatagttgtattctaattttttgccattactagttttgctgcagtgaatatccttgtaataattcttaatatatgtgtgcagcgagaatgcatacagaataaactcctagaaaaaaatctgtgagtatagtttttaatttagatagctgttgccaaatttcctctaaagagattgtgcccatttaccaataatgtgtgagaattcttgaaccacctccttgccagcatcgcatattctcatttttgtagtcattgccagtctcaggtaaaaaatatttcactgtcattttaatttgcatttctttaattataggtgatgttgaaaactttcttatgattcaaaagacaattttcattctttttcagtgtattctgtatccctcttctgtattgttacagaacttatatagttctttaaaaatacacacacacacacacacacacacacacaaacaacatatacatttaaagcttttatccatctgaaattctttttggtgtagagagcgagctaaagatctaaggtgattctgtatagatggctagccaattgtcccacaccacttattgctctttttctttctggtttgaaatgcttcctttattttaaatttcatgatctaattaagtctgttttcttggccaaagtaatgaattgtaaatctactaagagagttatttctctacccaccatttagtaggctcatgtgaaattattttcttgtaggatcctttcaagtatagctatccaccactagtagatgatgacttccagaccccactgtgtgagaatgggcctattaccagtgaggatgaaacttcaagtaaagaagacatagaaagtgatggcaaagaaacattggaaacaatttctaatgaagaacaaacacctcttcttaaaaaggtaactttataaataaaatgaaactgaatcacaagatgtggtctatccccaattctgacactagccagctgtgtgattttgggtaattcacttaacctgctacccttccacatttttgtgtgtaaaaagaaagaggaaggatgggattagctgaccagaagcaccactttagtgtatttaagtctgattccaggccagggcctgtgtcttatacctgtaatcctagcactttctgaggctgaggtggaaggatcgcttgagcaccggagtttgagaccatcccgagcaacatagggaggccctgtctctacaaaaaataaaaaattagccagatgtgatggtgcacacctgtcatcccagctactctggaggctgagttgggaagatcgcttgagcccaggaggtcgaggctgtactgagccatgattgtgccactgcactctgacctgggtgacagagtgagactttgtctcaaaataaaataaaggctgattccatgcttttgtataaagactagcaaaacacatctagaagtaattgttttatctaaaatttttttatttgtctaaaagtaattaatttaaaactttgatttagttcctttctctaatttttaaaagagcacttagtagttgtcactttttacaagtaatcaggaacttgatagatggataaatacaatgttataatttagaaaaatttaaagactcttaagggaaggaccatattgtattttctagagtaacctatgttatgtataatagtaggcactaaaatagatgttaatggtcatgttaatatatgctaaatagttatcctttttttttgtctttagattaacccaaccgaatctacttccaaagcagaagaaaatgaaaaagttgattcaaaagtgaaagctttcaagaaaccattgagtgtatttaaaggccccttactacacatcaggtaatcgtcaaagattttattagctataattttataacatatcttgatcaccttgagggagccacaaaattaagaaaacttctatttggtttttgaaactgtagaaatataaaaccaagagttatctgaagacttaccttggtttccagacgtagtgcatatgtttagctaccttgctttcttctattatgttgagtgtctttaaagggttctcatcacacatcagataataaaactaaatatttatatattaataaatctgaatggcatgtattttcctcacattactgatactattagacttgcccaagtttgggaatgccagaaatgacactaaagtaaggatttgttgattttactttccagaagccaaagatgaactggaaaaataggtttgtgactaaagccaaacttcaggacatctctatttttctgctaggttatttgattcaaaagattccaggttgtttctttcagcattgtataaagacctttttctcactgatgatgtttttggttggtaaatatattttgccttacgttacattgctacaccaactttatgatctcatgtagcattttctgtccctttacttgaaacctttctgtatagctatgttttatgtatatctcttatgaacaatatagccagacttttaaaaaatctaatctgacattctctaattgatagtattagcttgtttacatatattttgattactgttatatttggatttatctccgccatctatatgtatgaaagacagcaagcaagagagacatagatgcgcatgcattttctgtttttcatggtttttctttcccattttccccctttggagtttatcttttttgtttgtttacttgttcccatttttctccctacttatttggaagttacacattctgttttcactgtaaacctgttacatcataggtccttgcctgtaattgtagaggtatgacaggaaaagcaggctagggagaaagccagacagcttttcacctgcacattgggctctgctcctcccttcctccgcccccggtgaagtcccagagctgctcctacacagacacaaggacctaaccaacctctgtcttcctggagctgctcacagttgttgtgctggttactaagaacaatgagatccataaccttgtggttttctatgacttacttaagattaggctctagaagaaagccagcaaccatgcaaatttaccaccttatccaaaactaggcaaagcccttctgggagagctcattcttaaaaacatgtgttagttagattaaaaaacactcccaaggtacagacattcctgatataaaattaacctatttaaagatgtatctcaaaatcaacggcttgctgaaaattcactttagttaaattattcacctttttatataaaacaaaaacactattcttcccattgttttgagccacctgatacaatttggctaatgtaactaaactacacaaactgcttgaatcttttaaatttttttttaggtcataggcattacaatggaaagtaatagtaaaatttaaatattgaagctcattgattttactatttgattagttcttcctacagctcccatcccaaacttacttttatgtttacttttctccttccctattacttagaaaagctgctatatagtaagaaattattctgttaaatacattcctaatcatctttctttttaagttatgctcttttctgttggtgtatagaaatatgcctcattctaattatttgtaattaggtaaagttgaagcagcaatatcttctttgctttattatctataaccttccaaatagtttaaataagcgcaccttaagatagtgctgattataggattaatcagagccttcataactctctcttctgttcttcctggtttgcttttgatcttggggaaaaccgtaggactttttaaatagtgtgcattgaatcagtaagattaaaatacaaaattgtattaggtaattgttttgtaagtcttttttggtgaaatgtctttatacaaatgagcataagatattaactaaatatttttcttcaagctaaatgattagattgtcatttattctgattattacaaatgtcttatgtttttgtcactccctagcccagcagaagaactgtactttggaagtacagaatccggagagaagaaaaccttaatagtgttgacaaatgtaactaaaaatatagtggcatttaaggtaaatatcttaaagatacaataaattatgtttgagaatttgacatgggaagtgattttagacatattctaattgaaagattgaaaattttgaacttgtacagtgtttttatttatgacaatttttaggcatgttgtactaccttctggttctaaccaagtcgcatagctttatcaaaaaattttccctgaggtctgtatctgaatcttttacgtgcagtaataggttaatgtctaagttaatacaagggtttaatgtttgttgtaaataacaacccaagaaaaattactctttactatgtgaataatttaatttataataacagtgaaacataaaactataaaattgatagtgcattttccccaagtgtggtatattctggagtgtagtttatatcggatattaacctgatactgagcattaagtgtaacaagactaagtccgtcactaccccgtattgtaggttttcctgccttaaatcttctatttaatttagatgtaactaccaggatgttcctgatgtgctttgattatctactgttttttaatttctgaacaccatggtattaataacatgcaatctaatgtgcattctgtttttgtgaatttatgtcattaaattcaggcaattaacaggataaatatttaacagatggattgttttatttaagagggagtctgaatgacaatttgacttatatatgagtatgtttttagataggttgagatgcttttttcctgttagtggggaaaaaataccttctatgcataatcgtcaatgttactttgtaaactctttgttcattgattattcactgctaattttttttttagggagatatacctaatgctaaatgacgagttaatgggtgcagcacaccaacatggcacatgtatacatatgtaacaaacctgcacgttgtgcacatgtaccctaaaacttaaagtataataaaaataaaaaaaataaaaataaaaataaaaataaatttttttaaagtcattcttaagccatttccccccaaaaaagcataaaggttgttatgtgactactgtgtttataaataggtgagaacaacagctccagaaaaatacagagtcaagccaagcaatagcagctgtgacccgggtgcatcagtggatatagttgtgtctccccatgggggtgagttgtcacttagtagccacagcaggtgttgggtgtggtgggggtaaggggacctggaccttggctctgagtcagcagagatgtcaggctagaatctagaaattagcagagtatcacgagtcacctcacctcgctgtagacatcttttttcccacatgtgaaatggggtggtcaaagaggtctctaaagccctttccagcattaaaatgtattgtttctaacaagtaaaattgtttaaactgacaccaattgaaattgaatttcaaaagagaaatttcctcacttttagaactttttcctttttaaagacatttccattttcttctttttccttaatgttgagttccagaataatgctttaaaccacatgcatatccaaccgctttgaaggttcctgtttatatgctgaattacccttttggaatgcaggtttaacagtctctgcccaagaccgttttctgataatggctgcagaaatggaacagtcatctggcacaggcccagcagaattaactcagttttggaaagaagttcccagaaacaaagtgatggaacataggtaagcttttccctcacattcttctcaaatgtagtgggaagaatcagaaagagaaaagtgcctccatggaccaggtggcctccctttcttcttgcatctgctgggtgccctgcaaggctctggggatgcccagatgaaagagacctggtgttgctcaaggaggtcactgatagcagaaactcatttgcaggccagtgcaagagtctggatctgtccagatcacaaacacagattgtctcagcagttctccctgtaggagtgcttaccttacatactagaatgttttttgcagcattgtttgtaatagtgaaaaactggaaagaaagaatctaaatcgtaaccagtaaagcaatagtgagatacatttgagtatatccacactaaagtgtgctgcaaccactcataaaggtacagcaagtctatttgttctgacatggaaagacatctgtgatatattttagaaaacaaatctagtgagaaaaattggttatggacattattctatttaagagggggaaaaacttgcatatatagatatatacatgtatgtgcatgtatatagatatatcaggttgtgacaaatttcttgaaaagatatgtagaaaaggagaatagaaggggctgtattgtagttttgctttttttaaattggaattatggtttattggagtgttcacatttttccccccaggggacatttgtcaatgtctggagacacttttggttgtcacaactgggggatggggtacagtgggcatctaatgggggcagcatagggatgctgctaaaccactagcagtacacaggacagccccatcccccaaaaatgatctggccccaaatgcccatagtgtcgaggtggagaaatcctgctttatagggtagttaaggatggccactccgatgacattagagtaggccctgaaggaaatgagagagcaagccacatagataactggacagagacctttccagacagaacaacaaatgcaaaaggagtgtgcttggcctttgggaggaacaacaaggaagtcactgtctcttgactccagtaagggaggagcatggtgagagatggggacagagatagtaggatatcagatcatccctatggtgaggacttctgagcgagaggaaaaactattagttggcactaagcagagccatgaggtgatccgggcttatttttttaaaggattcttctgggtactgtgtagaaactagacggtgggcagtgataccaagttcacactaaagtggaatttgctgtatgccagcactgttctagatgctttagacatattgattcattcagtcatgaagacagccctgtgagggagaaaggcatttttcctactttatagagaagctgggaaacctgataatggctatggttgaatgaaaccttcagggctgggcgcagtggctcacacctgtaatcccaacactttgcgaggctgaggtgggaggactgcttgagcccaggagtccaagaccacccttggcaacatagggaaactttctttctacaaaaaatcaaaagcttagctgatagatcatgaaaatagattatgaacagtgaaattcctgagaaggctgaaagtgcggggaaccaaagcaggggagattagccttagtccggaggagggagaagcagatggaagtcagcagcctgccttgtttttacgtgtaatatttaaattttcaaattgtattacaggagggcctactttctgtttttatcaagagtttttcttttgttcaaagacactggttatgggaatattttgaaagggtaagaaacgctggtataaaaggtgttgcagattaatttgaagttcttacgaaacagtccctcaaaatgaagggttatttttggttttgttatgttcgagttgctttgttttctttgttttttgctttaccaattactgatggcttgcttttctataactgtgagaggagatcactgttctcctgcagaaagtgggagggaggcttgatggtggggtactgaagctcaaggaaagtacctttctcctatctagaaagggtgatttccttcaaatcataagatatttggatgaattctactgaataccatataaacactttcatttgaattttaccgaatggtatctgcaatatgttgtgttccttatacatgcattaattaacgaagctggaagatacatatacacagagcaactgtcttaggtgaacctggggaagaggaatgaggacttttacctctgttacatagacttctgtgtataactgttttcattttatattttacttttataagaaaattaactttttaagaagttatgttttctttggattttaataggttaagatgccatactgttgaaagcagtaaaccaaacactcttacgttaaaagacaatgctttcaatatgtcagataaaaccagtgaagatatatgtctacaagtaagtatactttcttcctacccaaacaaagttgttaatgctgatcaacattagaaatccctttttttctcacggacataaagaaaaacatttggcatagacacgatagaaatactgtcttctttgtgaagagatgccaaatcagaaatggtaagcaggccaagtgtggtgctgcctgtaatcccggcactttgggaggccgaggcaggaggatcacttgagcccaggagtttgaggccagtctgggcaatatagcgagaccctgtctgtacaaaaaaattaaaaatgagccagttgtggtggcacacatctatagtcccagctgaggcaggaggattgcttgaccctgggaggtcaaggctgcagtgaaccatgatcatgccactgcactccagcctgggcaacagaacaagaccatttctcaataaaaaaagaaaagaaatggtgtaagcagtgagttatttttggagatctactaaccatttgaaagctctggccatttttagcaaagcacaaggtactttggggagtatcaaataattcagtcttgcagaaaaaagtaccaattagtgcatttaaatttgaaagagacagaggggctctctgagtagctgaaggctgcttaagggtttctgtacctctaggaactgactgctctgctcctgtctcaactagaaattcagacctctcaaaatgagaataagcatagacatatctgtccaccaaacaaatctaatgccctgttgcacttccacctccttccaccagccttacagagtagtgggccccatcctttcagtgtttggatttctagtattcctgtttgtcatgcccatgattaatggctgttttattgatataaatctttcatcccctcttccctcttcagctcagtcgtttactagaaagcaataggaagcttgaagaccaagttcagcgttgtatctggttccagcagctgctgctttccttaacaatgctcttgcttgcttttgtcacctctttcttctatttattgtacagttaaagaagtggtgccgggtaggaaccacggttccttcgtccattagttggaaaaagtaacagacctaaaactctaccaagctactaaaaacattgcacatctgtgcttcctaaaaggaaatatgcagcacgtggaggggaacacatacatgtcttgaaaataaactgctagaataaagaaatgctggagaaattgattataagagactatagctatttagtaaagtaagtaaaggcatatccattgtgtaaattaatagtttaaatataatttattttttccttttgatctgaatacttttaaagcttaagttttatcgtgtaaatacattagctaaactgaaaagtataagtaacatgctttgttgcagccaaaaaatgtaatctgcttttttatgacagaattattatagctgagctgacttactagcttttctatactatgtatatagaagaacatgtatattgagaaagaaaacatacttatatagaggaatttatgtaaccatgactttgtaattttgagaattcctcccagtgatggtcagtattcttttggaatgtaaaccgatttaatgccaaaccaccttaacctttgtttctcagtgttccttaacagcctgccttttattaatctcaggcttttttatgaacactctcatttcagtagaatttggaaaactaagcgtggttggaatttctttgaattctgttagtaatgcccaaaagaaaagtctcaagcagtccccctatccagtcatttttatggagtttcatgttgtccactatagctggacactgaaccttttgcctaatttattataaaggcctgaccctctattgtcccatcttcacccccattccagagcagaggagtctctgtggaccatgaattgcactgtctccctcctcatttctaaatgaaaggtattagatataaatttttttgaaaggttagttgtttgagatgctaagcaggataataaatttagattttaaaatgttccctgtaaaagtcagcccatgacaaggaaatttacaaaatactagagtatctagaagggtgaaaacaaaaaaaaataaaaagaaacacagacgcccaggtgtcagctctccgtttaaagaatgaaaaatgtaactcatgatgatctgtgaaaccttcaaactaggaccaattgacttacttgatattctgcctttgatatggtagtacccacccggtattcctaaaatcctaaaaagatacaccttgcagtagcagaggcaatgacatgagtttgttttctcattaatatgaccagtttgggtctatgttggttcacatgtacatctactttatatgaaagaaaaaacagttgtctgcctgtaaaatgttgagtttcgattgagccatgtttggagattttattactattctgaagggtagtgttgttggttttcatcttcaagaagttgattccaaaactgagttatgaagaatgatataacagttccttcaaaattggcctaggaaataaaaccttaaaaggacactggtgtgctactttgtcttaatttgggcttttctgtttcagtttgccacctccagctgtgaaatggactgcagtccaccctaagtactgtgcacagtatctccctgtgtgtgtgcacagtggcttccccttacatggtagatttttggccttaatataatctaatcccaaagtagttgtgtatgttttctgttccttggcaaataaatgaagaaataattagccaagattgaaaatgtattgtcctaacggtgtccctttaatgtttcatatgaaaaattatgttgacccactaaaatatccttgctcaatgtctggtcagttgaatttaataacatatcttgttaatgtttgtgtgtctattaaatgtgactaagcaggattactgaaaattcactataaaatcaaaggcatctaaacgtttgtacttgtcttgattaatcatatatttacacttgatttttttctgtcttcatttgtttttatttaatcataattgcatgatttttttggtactctaatcagtaattttatttttaatcatgtcattacctattcatgaccaaattaccaaggaaccaacatttagatttagatatttgttttcacttaggaatggaaattaatagattttccatgaaagcattagtgaaatatcattaccttgatctgcaagtagcctaaaaatgcgattgctggtaaacctggcctcaaatttcatactaccataactgtttttatatattgccactaattttgactggatttaatagcactttattgtacaactacaaaaaaaaatatattcctagaattgttgccagtgtaatttctctaatgttctggtgcttttcatatattttcagtatttttattactatattggtattttctttgtataaattgattgattaaaagaacatgttttctattttaatatgttttagaaaaataattacatttatgaaataaatatcatcaggaaaaaaa

SEQ ID NO: 15101 - DNA, 2397 bp, Homo sapiens
agcataatgactttctttttgatatttatcacagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcaggtacaataacagaatgtcttggaaatacagaagctgaaattttgtggcagtttgagattttttttttttggctttttgttgcaaatttcttttagtttttacctaaaatgaagttatttaagttcctcattccttttaagaattgagatttaaattctacacagcttccatagaagaaagttgaacttaaaaaattagtatcggcccagcacggtggctcatgcctgtaatcccagcactttgggaggctgaggcaggcacatcacttgagcttaggcattcgagacaagcctaacacagtgaaaccccgtctctactaaaagtacgaaaattagctggatgtggtggtacatgtttatgatcccagttgatgcagaagaatcacttgaactcaggaggtggaggttgcagtgagtcaagatcgcaccactgcactgggtggcagaacgagacttcgtctcaaaaaattaaaaaaaaggatcaaggttatgaaagcttagaatgaattcatgtatgcttgatttgaaattattgatttaagattagtaggaaatagcagacaactgatggtttgagtacatattcctgtttcctagtttcttctggaataattcaataagcaagacagttgggtacatctttgcttataggttttcataggcctccaaggagatgacaggtacaagcctacaatgtttcatttcccttttctttctgccaagaactgagggaccagctgaggagagaggttgcctatcttcagagcctgaggatgaagaccacaattttatggtggtcttttctgtggagtttctgaggtcaaaaaaaaaaagacatgtgtctaagcatgtccttataaaaattgctggattttaaggataagggggaaatcttgtgagtttataaaccaaaaaaaattaccagagaatgctaatgagaataggatctcaattttcatctactgcactagataataaacaataacacatagtgacaattgagaaaatatcttacctagatactcttcttatgccagacatttttattatgttcatgaaacacttaaaaattgatcatgtaggaaagcttaccttatttgtggccgtaacctgataaaagtatggatataaaatactgaaaaacacaatttttgtaccttctccccatccccttgagcaagaaaagcaaaatggaggaaagtgtttacaaagtcccattttgtaaagcataattaatatgtatatgagtgtatgtatataggactatgtgaacacagagaaaaatacagagaaatacatactaggcttgtagggtaagtgctaaagtgaaggaggggtggtggttagtgatggagccaaagaaagaaaagactgcatttcagaaaaggcaaggtctcatttatgtagtagtgttacgtgttgagtctgtatattggaatatgaaaacattacatatgtaaataaccagaacaacacaagaattagaaatcctgagcagaccggtagccatggcagaaattataaaagcataacaaaatccgtctttaaaattaaaattacacctgaggccaggtgcagtggcccacgtctgtaatcccagcactttgggagtctgaagcaggcggatcacctgaggcccaggagtttgagaccagcctggccaacatggtgaaaccccgtctctactaaaaatacaaaaaattggccgcacgtgatggcaggcacctgtaatcccagctactagggaggctgaagcaggagaagcgcttgaacctgtgaggtggaggttgcagtgagccaagctcgtgccattgcactccagcctgggcaacagagcgagactccatctcaaaaaaataaaaacatctgacttcttgtctaacctttaaagaactggtaattcgaatttaaactattctagatcatagaaaaagatagcttccaaatatattttatgaaactaacacaaccttaacaatgaaacttcatagatgaatacaacaaaagaaagctgttgactagtttccctcatgaatacagatgaaaaagttttaaataataaaccatagctagtggtgtattaaaagaataagctgttttcagcaagaaggtatgagaacaattttttaattaaaaaaaagaaaaaagaa

SEQ ID NO: 15102 - DNA, 2523 bp, Homo sapiens
aggcattaggaagccttctttagagttcaaaattttagaagcctaatttgctcttacttccttcaattatgtgccatgtgttttggtttgtatatgttttaaattgtatatttccttggaatatgcttgaaatatttaagaatacattttcaaaatgtataatactgtattgttttgttgatcagaataataagtctcagttaaatgtttgttattactgatagtcaaaatgctcaatagaaatgatgagaggcattggttccaattcattgtcaaatgaacgttttctaattttgttcacagattctttccctttcgattgttctgtatgttaagatagtggcttctgctctcactgttttcctatttatattactagcaggtaggagtgctaattagaaaaacttagatggtattgaaattacagttgacaacttatatttttatgagatggagaaaaaagattaagttgatataacaacaaagtggactttttttcttccttatcctgcacgaaatattgcccttgtttcctctactttcctcttggtgttttctctttttttcaaacagaaacaggccaattccattttcttgagcaagaaagcttagtgtgttacttcatcaaggccagctaatactgtgttaaaccgggctgaaaatgagaaaacttgggagatggaggaatggggaaatggcagtgggataggtagggaaggattactcttaattgttttaaaagccataggaaagtcttccttgtacgtggctgtaaatttataagaactattgtgtcacataaaccaacaagaatgaacctttgctgcttcagataatttgatttttccagcaaggaaattaataagttactgattcttcagcatagaaacaactgagaagaattaatgcaatgtttcttcactagaaaacccaacccttcatttcttttcattgctccaaaacccagttttcaactaatggttttctcattaaactaaatgtttagaaaagttgtttagagtttttctttttcttttacatagtcctcctgatccagtataagactatttagtaacgtgcatttgtatggtactatctaaagtaagtcagattgatgttagagatcgggtagctgcggaacaaaattagttatatcctaattaggtacagtgaatgacacaaaatcattttagcaatgcttcttaaccttttggggtcacaggcgttttgagactgatgaatcctagggacttatttacccaggaaaatgcgtatataacatacatatctccctaaagtttacaatattgtagtggttcatgggccccctggttaagagcccattctaaagtacaatagggcatcatcccttttcctgcaaagcccaaaagtatatttctagggcatgaaaataacttgagtctattttaaggaattgtttcactctagaggtagataggggacctggctagaatctgacattaaaatatactttttaaaaaatattatatttggggtggggaaagtgatttaaaggtgaaaaaaaaacatagtattcagaagttttggaggttaatgtctttctctaagatttgccactttagaaattcaacagaaaagaggtaaaacagaaatggaatgtatctggaacatttttggcctccatagtgcagatatactatattaacaagtaatacatttatttacctgtcagatctccaggttttaagattttgagctttctagtattaggattcattaaatgttcaattcatttcatattctaaggaattaggttatttacttactaattcaggatgttaaaataacatccaagtcggacaaccaccaccaatgcacacagttaatgagatttctaaaatataataagtacaatgtaacaaacgtatagaattttgcatttgttgccaaaattagatgtttaatgacagcttatttaattcccatttgtgggacttctggaacatagaaaccattatcttacctggttatcccttgactaaatagcatatctgcaggaaaatatcttgtttgtagtgatatgccccaatagtgattgatttcactcttgaaatgagttatatcacttaatttgtataaatgttatgagtggagagacatgtacatgttaaaagcatgttgcattatatattcattttttaaactctataaatgttaagaataatataattgcagaaatatttttcttaaatacaatgtgtaacaaaattctccgtagcaactcacccactttgcagtttatgtgatccacacttttaaagaaattccataaatgtatattttgtattatgtattatttcctggtccaaagaaaatatgtgaattcagttctaactttaagaatgtactgtttgttttcaagttcattgaaaaattgcattcagcctgcgaatggttgcagattgtatgttagatgaaaagtagaaataatttctagtttggaaaactggtgccactaaataaacaggcaattacataatg

SEQ ID NO: 15103 - DNA, 443 bp, Homo sapiens
ttggactgaagaggcttaagcccattcagtatccttgattgcatttatccaacggcctttattcttcctgctgacagcagtaactcagaggaataggtagtagatttctgaaaattatccagccatggaaatgtaggtggggtttgagtttaaggcatttaaaaatgtaaatatctctagctaaatttatcttaagtagaactctgtgtttttgtaacacactgccagtgttaatatcaaattttagccaaattattactatgtgttttaatattttaaaataatttcactgcccatctttactggacaaactcatttggagttcaacttgtgatttctgaaagaactgatgaaattgggtactgctttttttctccatttttcgttttgttttaattttgaatttcatggtatatacttttagttcaaactcagctgtttgt

SEQ ID NO: 15104 - DNA, 85 bp, Homo sapiens
  misc_feature (20)..(22): n equals a,t,g, or c
  misc_feature (82)..(84): n equals a,t,g, or c
ttttttaaaaaaaaaaaaannnaaaaaaaaaaaaaaaaaaaaaaaaaaaaaaaaaaaaaaaaaaaaaaaaaaaaaaaaaaannna

SEQ ID NO: 15105 - DNA, 148 bp, Homo sapiens; identical to SEQ ID NO: 8938
  misc_feature (136)..(136): n equals a,t,g, or c

SEQ ID NO: 15106 - DNA, 158 bp, Homo sapiens; identical to SEQ ID NO: 7318

SEQ ID NO: 15107 - DNA, 126 bp, Homo sapiens; identical to SEQ ID NO: 7221
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c

SEQ ID NO: 15108 - DNA, 8430 bp, Homo sapiens
cttgggccgcatattaacactaacaatagctgaagaactaaaaagaaaagaaaaaagcaaaaacatctcaatgttttaagaaagtttatgaatttgtgttaggccccattcaaagccatatcctgggccacatgcggcccttgggccgggttggaagcttgccctaggaattttagatggagacgctctgtcttgccgggtgtagcacccgctcctgtggctcctttcctctccacactggccaagcaggagctgaatgctttggaggctccctgggcataaggcccaggtgaccactatgtgttggtgctcagcctttgcacatgctgtccctctctgtggaacacattccctggcccgcacatcttcctcacccccaattacctcccgggctccacacagtgcatttcctcaggtgctgcgctgaccagtgtggtagctgctggccacgtggctatggagcccttgaaatatttgagttccaatcaagatgtgtaagatacactccagatttcaaagcaaaagcaaaaacagctcattcacactttttatactgattttatattgaaatgaaaatattttggatagactgggttaaaaaaaaattaagttcacctgcttctttttactttttgaaatgtgactgtcagaaaatttaaagtcacatatgtggctcacactatttctgtgggacagccctgcctctagctaggggctttggtgagaaccagatgagttgatgggtctcctctgggccctgcttccctggctgctgaggtgcaggaactgtgaggggagggcagcctgtcacggtgcccaacacagggcagggctggacaggtacaagtggaacaggcggataagctgggaagggcacagagaaaaggagctcctcgtgacagcactttcccaccttttattattcaacacatggaagggggtggagacacaaggatagggcaatggtgagtttcaataaataagagaaacaggatggacaggcagtgggcccatgcctgcacggccccacataaataaccaggttgctgagccagagtggaagtcagggctgggcctggcagccgcctgcactgcccagaagcactggcaccacagggacacagaaaccactgaggcccaaggtgtgctccagccccaccaagtcttctccctaaagctcctgagatcttggggctggctgggcaggctagggctctgtatcacagtcctgccgggatcaagtctattttttcagtttcattaaaaacagctgggggaggggcaggcacatgcattaagccccttccgtaggcagagccatggatggacagccccatgggggccttgaaggcagaggccctggaagcagcaaaaacggggctggataaagctactaatgggagggatggtagagcccagctccccagtcccccacaacccagcccagaacctacaaagagctgaagaggccctgggtactgagacgtctctccttacttcacagtcagaaaaatggacccagcgatggccacagatgtgcccaagattagaacccagggactcactctcctagcccaggactttctgctaccccttccctttatagacctgctggaagaggagggggacgcacatctgctctagggccctgtacagaggcaagggtgtggctaattaccaaggaatggggccaggggtgacgggcacaggcccctcccctctgccaagcccagcctctgatgatacagagaatcccgtgggctcctaggatccagccagggcaggcacgggggtcggggcatccttcaggggagcaacatggcagcagggccaggggcggggctcagcctgctcctgtacacagtgcccgccggccacctgcctcctcactggggcagacgctcccacctccaggccttggtctttgctgtctcgtctgctgggccattgcttctcggtcctcacagtcccagctgcagctccacctcctccaggaagccttcggaacctcccagggcagggccgcagtgtccttagactagaacgcccctcagatgaccaggttgctctcacttagccggaccacatagcggttctcctggtgggcagggtgaggggtcagagctgagtcaggggctggcttctggctccaggaaagtggcccctgcctagggcccgctgcacttccacccctgccccgtcttcggtcagggttggcccaggtgccaacagatgcctttctccttgactctcacctcggccttgttctctgctgggggcttcagccactttgtacggcttccgccacttcctagcagggcctgctgctcaggggggaggccaggctgtggggagtcagggagatcaccccacgagggcccagcctccgtgatggtcttcacctcagacaccattgaacttgtccgctgctcaggaattcgagccacgcggaacctgtgaggagagtggggcaatcatccccgttagcggggatcccggggcacagagaaggcagcacgtgcccggggtcacacagcaagttcatggaccagagccttagcctgagaggcccgggtgccatgggggccaagatgctgccctagggatgcaagggctccatgtgagacacaacataaccggaaagtcctgatctctctggccgcctccactgcccagagaggcccaataagggcagggctcccattgagcagggtgctcagggcccaagctggggccctgcctccccctcccggcccccaggctgtcacgtctttacctgcccctgctgcatctgtgcccatctcacctgcccacagacaagatggtgatctcgccctgacgccctgccttggccccggccttgggaaccctggtcgggttaggcagaaggctgggaacaggagtagtggcggctacagcctcaggggacagcagcacctcgggccacttcttctggctacagcgggagcagcaggggccagagagcgaggccaggccctgcacggtgtggagatggtggcggtgcgggcagatgtgtggcacgttcgggggcgctggcggcagcctgcagggggcacaggcagaagtggccataggccaggccaggggcaggagaccccagcagggaacagggtgacttgagggagacccaagtgggagatccccaggaggcaggctggttaatgtaggttttggccccgttatctcccaccagcccactcacttggacacaggcctgtggctcgtctgcaccagctgtttgctgtggtactctttcagcagctcctccagggccgcagcattctctgtgggtagctgcagtcagaccctcactgtggccatatgggacacacctcccaccccctgccccagcagagaaccccccacctaccctccataccaccactcccagcctgggctgtgcgccttttcctcccacttcatcaggcaagaatgggaggcagaggtgtgcactcctgggtcagagagcaccaggctgcttgaggcaccctggcagggaaggcagagcagggcaagactctgcccaccgcggctgcctcacaggctcctggaggaaaccctcctctcctgggcactgggatggggtcagaccttctcctcacctttcttctctgtgatcaagcgcaccaggaccccaatggtgtcctcattggcatcctcagtccggtaggcagggttgattcctggggaagagaagggccctgatcctggggaagagggggaagccgcactcctgagctaaaccatgatctgccagcagagggcaaccctggccttcttaagggccctgagcatgtgcatttaggtgacaagcctcccagagcccctgcaaatgtgggatccaggctcagagaagcccatatcaccttcatgattcaacaccagtgcttcctgcacccaacagcccgggtgcatagaggcttcagggccacgtgaactccagtcattgaattgggcgggcgagggggcggtgcgtcagcgtcttctgggtctgcactgtctcctcctcagcctcaaggagctgtgggctgccaccctacccagaactccccaaatctacagcaaactgctattccatggcctctctactgtgccctatgtaacaatttaactgagtgcccctagtcagctttgggcccaaatctcaagggtgtgagaatgggccacgatgatcagccctgggcccagcagcaaacagagctcccaggacttgcacccaggcagcatccagcagttaaagggaagtctctaggaaaacaagcacagtcccaggcaaaatggccctgagtcaccacgtttcctcctgccggcttactgctcctgtccgcttcctgcccccgccagacttcagtgtcaggacttagaagggtctctggctcccatgccagccccagacagccgagggtgctagcatgggagatgccatttcactcttgaggtagccacaggctcccatgggcccagggcagggtgtgtgcgagtgggcccctgccctgcaggggagtagtggtgtggggaagaaggaaaggggcccggggccctgggggtgaaggtggtggcgcatgcctgtccctccggttccaggccttgtaactcaaactacagcctggaaccaaaacccgagccccttatggtgcctgcccaggacaggacagctgccctgccagccctcctgccacagggcactcctgctactccaggccagaggtcagaggtcaccttgagtaactccaaggccaccatccgaccctggaaccatacacacaactgtggcctccaaagagtccagatccccacatctggcaaggcttcacccagggtaggatccactgaagcacttgaccagctgtgccacctctgctctgcccccacggccacaccttcgtccccttacctttcctcccatgttgtcagtctgcagctatcacctcccaagcctctccctctcagaccccagaggccaggcaggattccgctggcagcccccaagtggagctggggctgggctcgtgcccccgtccttcccacctggaccccagctgggcctcaccactgcctccacctccagggccgggcccgacctccttgtgcgccgtgcagtggtagcccttccgcttgaggaggttgcacaccaggatgcccaacagccccatgaggcagaagacagggacgatggcgatgaccgcgtactgggcggctgtctcctctgggccacctgcccgggtgccgttcccaggctgccgtgtctcaccaccgctgctggcccctgctgccacctccacgccacgtcgggcccgccgcccccactctgagcatcacagacgatggaggcaggacaaaagcagagtgacacaaacacagagagacaggggcccagggcccgagtcagtgggggctgcaggagagccaatgtgcccaggggagcccactccccgccatgctggggatgcaaaggtcaacccactgccctcctgttttcccttctggccatcgaagcattgtcctgaacaaggcctcctcaggacggccagacacccagccccaccctcccctcacgctggggtcagggggtgaagagatggcacacaggacacatgtctgggcacagggacgtgggatctgcctccctgtggcctggccatgaatctagtgcctcagggggtgactgactcagtggcgggaggaggtgcgtgtgggtatgtgagtgtttgcatgcgcacactcatctgcatgggtttttttaggcagggtctcacttgttgcccaggctggagtgcagtggggcgatcacagctcactgcagcatgaaaatcatggactcaagcaatcctcccgcctcagcctcccgagtagcaccaccacgcccggctaattttttatttttattttttgcagacagggtcttgctatgttgcccaagctggtctcaaagtgatcctcctgccttggcctcccaaagtgctgagattacaggcatgagccactgcacttggctggcatgaatctctttgaagggatggggacaggggacaggtcagtatgtgagtccccagcccccagctgtggctgccatctgcaggacactctctgccactcggaagcatggtgggcagaaacagccaggggagcggctgactgtgccctgctggagaccctttggctgcacgccctgccctgggctggaagaaggaccccactgcccccacatgaacactgcagaggctgctgggctccaactcactggcccctcccgcacatacccctgcaccagtcctagccccagtctgccactcaccatcacagccatgagtacccagaggtgcccaggaacatggttgacatggaacgcggggaaccccccaaggcccaaaccacctgcgaggagggaagataccactgaggcccagaagtttccccaaacactatccttaggagaggctggattccttcctaccaggcaccctccgtggtcctgccccatcccatttcacagatgggaagaatgaggcctgctcagggtacaataaggctggggccccaggatccagagtcctggtcacccagccaggagccctccccgcactccctttggcttacccaggccagcagtctccacagagtgtatctcgagttgccatgcccacctgggcctccagcctcctccaaaggctgcaacgggcatggggctggcatgggctggagccccatgcagctgagaaggtgcctggggggcagggcctgcataatgtgccctgccctgggtcctgtgggaggtaaagggtgagagcatggccaggagccaagcctgaggacccttgggggccaggcacaggactctgcccctggccctcagggccctcccaggacaggcaggagagcagggcaatgctcaccaggtcgggctcctccccaggtgggcactgccaaagggttgttgatgtcagggtggcgagaggccagggcagcagctagaagaacagtaggcattgaaagaggcagaaagtgctgggtgtggggtctctggggtcatctatcccccacctatttcctgaaaccccagtggtagggaccactgactaccccacccgggcttcagggacacactcttctaacctcaatccctcacactgaggaaaacctgtcctgtcccagacctgctgcaagaccagtacctgggcaaggagagagccacatctggctctggaaagtgctggaaagccccagataaggccacatcaggatctcaagcccttccagctaaccagaacgatgaggaggaaatgcttccgaatcctctctcgtattctgcccccacttcctcctactttgggtccatccctggccccatcacagctgggcatatcattaaccagcctcatttataatccctggagccaagtctgcaggtggcgcttcctattctgggctctcccttcagcgaaagtctccaggaccacatcctcctctgcaatcttccctcaaggcgaggctaccccattcacacccacacacccaaacagggagacgcatcccaaaagaaagctccatcttctcagtgtgtgtccccagcccatttcactaggagttctctctgcttcccattcttaggaatgaactgtctctcctgaatccctcctagagtcccccaatttggcctaggctggatgaggctaccatcagctgccctggagatggaatagggatctcctcagaccccagagcggctcccagcacctgctaaggctggaaggcctcctgtacatggagcaacccttagcaaggcccaaggccaagtctcaccctccctgagcttctagcgtcacagcagaaagatgggccccagggcagaccccaagatgctgcaagtctgtaatgtggacttgcctgcagctccgggcagctggcctgatcctgtgatcctgggacctggaatctgggatcccccagaccaatacagatcttgaaccccagcacctgaggtgctatggctctcagggtccaaatcccaggcctcttttgcccagtttcctcttggtgcccagcataccctctgggctgggctccgttctcatgcctgcgtgccaatgggcatcttgccctcagccatgcctgccttgcccataaatgccagcaagcccttcattctccatctccctgacaagcctgggtgggcccagaggtgcttcctagggtccagctgcctcagattcttgacgagctgagtaactgagccctgcccagcagggggttccccgggagtgtctgcaccctcttgctggagggctgcagggctgagggtgcggcttttctccttcccagggcccatccccagctcaccataaggaagcaggacaggggccggcacagcagacttggcttcatcctcaggcccctggtggtcgccggcct

SEQ ID NO: 15109 - DNA, 688 bp, Homo sapiens
agcagctggcaaatagggactccaaacacactctggcagccgcaggaaatacttatttgggtacactggtgatgcctgctagtcccctacaatggacaccctgtcctacactttggcatccttttctgctccagaacatccctcctgatgtccagcctctgtttccttcccctcttctggtgcaggtgaaacatctcctggatcttcagaggtgtccctccccttcctgcccacctgaaaagccctggagagagacacctgtgccctaggtacccaaggagagtcaaatcccaaagcacatctgcccagggtaggaggaggcccccagcttggcttctgctcaggagaaaggcccctgccccctgtgaagccaggcctcccgacagccccagcatggccgccccatagctgccctgtgcctgctgcagacaggccggggactcccacaggctggtcctctccacacctccccaggttccatcaggtgtcactcttgttcttcagcctctctctgaggccgttagtttaaatgtgtccctctctcccgtctttagacaacataacaaacaataaaaccctaaattaactgaaaattgtctctccccagagcctgaggccccacccagctatggcctgccaggcttcggcagggagctgtctccctcaatccacctggccctggccctgg

SEQ ID NO: 15110 - DNA, 576 bp, Homo sapiens
tttcctttacccttcaaagctcaacacgaaggcctctctttccagaagcttctctagaagctttccccaaagtgggtctggctcccacagctccccaccccatctaggtcctggtccttctgcatggccactgtccacacctcttccagggaggctgactcctcccttgaggctggaacatgtctggccacagctcttcccctggcagacctatggggctggggtggtcacggcagccagtgctctgtctttgtcatctctccagcacctactgcgtgcgggcactggagaaatcggtatgaacaagacagacaaggtccctgtctgcagggagctccatcccaggggagacccaactgcaaacagagaggtgcccctgccatttggtggtaagtgccaagaaacgaaataaagcagagtgggagtgcagtgtgtgatacttcagagaaatatccatggtggcgtcacggcccaccggtctgagactgaggcccccaggcccagacggtggcctgctctggagaagcctccggccagtggacgaggcggacacagcaggacaaaggattcacatca

SEQ ID NO: 15111 - DNA, 3471 bp, Homo sapiens
ccggcgccccagcccgtctcccggccccgggcgcgcgggaaccccgggtcctgcagcctcccgagtgcggagaggcggggccgcccgctgccgcccggctgcctgcgccccctcccgcggccccggctctgggagcggggcgccccgcgcgcgggcacacggcggccagagcgccgaggcggtaccttcagcctgcaatgagaggaacccgggagagcccccgggagccagcgaagagcttggctgctgcgtccagggctgctgctgccgccgcggctgcttgaaactcctcaaagttgagagccggctagagggtgccgcccgccgggagccggagggaaaggaagtcggaaggtgcaagagtgacagacacggacagacggacgcgcagaccttcggaaggcactgcgtaggcagcctccccggagcccacgaggctccccagcaccgtgagttttttcctggatgggtggttgctaagtatttccgtttaattgtttgtagcgtacgtttgcgtatagttgtgtctgttggagggagtttaaaacaacaacaacaacaacaacaacgcaggatgcaccttaggaaaaaattgagtttctgatggtgggtgagacggtgggttgtatggagagaatgtgactgtacatttttataagcaggactaacccaggaaagaggaaaaaatacatttaacagtgaagaggcaacacagagctccctattgtgaaataaaacccatttcaaaagttattggaaagaaagtaaggtatggctcttatgggttaactagtggtagtcagtttctgctttttactccctctgaattattaattgtttgccaggttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatgattggtaggaaatgaggtaaagtacttcagttcctcaatgtgccatagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatcagattatgctattttgtataaagcaccactgatagcaaatctctctccaaaattcttaa

SEQ ID NO: 15112 - DNA, 1975 bp, Homo sapiens
aaccgaatccttccatccaatgcaccacataatttagtcccagaaaacagctgagagcatctaccctcatgaaacccctttgtctgtgactggtccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatgattggtaggaaatgaggtaaagtacttcagttcctcaatgtgccagagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatcagattatgctattttgtataaagcaccactgatagcaaatctctctccaaaattcttatagtaaagttgatttttttaaa

SEQ ID NO: 15113 - DNA, 506 bp, Homo sapiens
ttttagggaacagtatgtagatccgctgctcggtagcattgaaaagtccctattggatggtgttaaaaattactgtccctgccccttaaacaccaacctcaccctttggacaatatccttcagagccaaagatgttacaagcaagcattttattctgcttactgccattaaaataattaggaagaattctgtgacttgtatgaccttggaaatcatcacctcttcttgctttatagaaacgcagactcaagagatgctgtgatttgtttaggatcatacagctagtctggacacaagggaaacctcttgatccatgaaagctctccagcaatgtgatattccgggaatgtttaatagagctaggaccatcctctgacaaggaagttggagagaggattcctaaattaaatctttttcggaagggaccgctaaggttcttccattcctcaaatccttgatcctatgaaagtaagtgttgcatttgccagggaaatatggacagtgct

SEQ ID NO: 15114 - DNA, 266 bp, Homo sapiens
gtctccaagggtgagacccctccctcggtggctgggcgtgtcccctttagccttcctggaccccattaccgcccggcttggagctggacgaagggacgtaattggtaggcgagtgggttgggcatcttgactcaaggaccagagtctgggcctctggtgtggacccctgccccctccccgctctgcgcggccgttctagaggtccgggtgggagctggaggaggaaagcgggaggaggcggcgaggccgcggggcggtatgagggg

SEQ ID NO: 15115 - DNA, 1207 bp, Homo sapiens
caggactgcattttgctccggagcgtccagagtcctggccctgagcgggaatcgcagtggccgaggctgagcggcaggtagaaggggcgtctccggggcttcacagggaacacaggggcttcggcccaaccacaagtacgcagttgcacatgccctacttttgcccattctttgcaaatcccctaaggaacgaacgcgcctcgcgtgcgggcctttctaatcttcgcttgtcccttcacttccacagctggaggtcgaattcaccacgtcacgtagagaaaaggggcggtgtctcgggtctccccgtgtggcatcaaggcgggctccctataggagctggtgtggacgtccgggcgtggggttagggcggatgcggggatcgcggggcgggtgttgacattgtgctctcaccaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatgaggctgtg

SEQ ID NO: 15116 - DNA, 1207 bp, Homo sapiens; identical to SEQ ID NO: 15115

SEQ ID NO: 15117 - DNA, 3901 bp, Homo sapiens
attttgatagatagttttattataaaaaattggctttttgattatggaagctaataaatcccaagatccccaagatcttcacggtaagttggcaagctggagacccaggagaactgatgatatagttccagtccaagttcaaaggcctgagaaccaatggtgtagttccagtccaaaggccgagtctaagacccagatggagccagtgtttacttctgagtctgaaggctgagaaaagccaatgtccgggtctcaaagcagtcaggcagaaggaagtctctcttactccggagtgggtcagtcttttgttctagtcaagctttcaactggttggatgggacccacctatattagggagggcaatttactcagtctccaattcaaatgttaatctcattcaaaatactctcacagaagcacccatatttggccaaatatctgagcaccaatcctctagaagttgggacattaaccatcacaggccgtgcgtggtggctcacgcctctaatcccagcactttgggaggctgaggtgggtggatcacctgaggtcaggagtttgagaccagcctggccaacatggtgaaacccccctctccactaaaaatacaaaaattagccaggcgccattgtccacgcctgtaatcccagctactcaggaggcggaggcacaagaatcacttgaacccaggagacagaggttgcagtaagccaagattgcatcactgcactccagcctgggcgacagagtgagactccatctcaaaaaaaaaaaaaaagttaaccatcacaggtagagtttaataggctttatctctgaaacttagtctcaaacagtccagaaaataattatatatttgtagataggtacatacaaataaaacaaacagtgaattgttaatatttgggtaatctaggtatcaggataaaggatatacaggaattatttgaactgttttttttaactttagatgcacaaaccttgtaattatccttgacactttccctcccacaaccaagccattaccacaccctgtaggttttactttcctaatatacatcctgtagccacaatttctctccatttccaccaccaccaccaccaccttggtccaaatcatcatcatctctcacctagactgctacagtaacctcccaacttgtctccctgtttccactcttgcctcctctacaatccattctccaccctgaagccagtgatctttgcagaatacaaacttaaagtcagctaaatgcaatgcatgatccttgattggtttctgaaaattaaacatttataatgtttacttagactgtgctgctattacaaaataccactgactgggtaatttataaacagaaatgtattttctcacagttctggaggctgggaagtccaagattacggcactggcaggtttggtatctagtgaaggccagttcctcatagatacgccatcgaggtgaccttacatggcagaagggacagaaggggccaacttaccccctcaagctctttcaaaaggcgttagtccattcttgagggtggagccctcatagccttattacctcctaaaggccccaccacttaataccaacaccatggattaattttcaacatgaattctggaggagacatattcaaactatagtagacaccaatgagacagttggggaaatctgaatatcaactgtatgtgattatagtattgtatgaatgttaaatgtcttggatgtggtaatggtattgtggatatgtatgaaaatgtccttgttcttaggagatacacattgaaagtacatagcaattaagtgtaaagaattttgtggggccaggcgcagtggctcacgcctataatcccagcattttgggaggccgaggcggactgatgacctgagtcaagaccagcctgaccaacatggagaaaccccgtctccactaaaaacacaaaattagccagagtggtggcgcacgcctgtaatcccagctacatgggaggctgaggcaagcaaatcgcttgaacccaggaggcggaggttgctgtgagccaagatcgcaccattgcactccagcctaggcaacaagagcgaaactccatctcaaaaaaaaaaaaaagaattttgtggctgggtgcagtggctcacgcctgtaatcccatcactttgggaggctgaggcaggcagatcacttgaggtcaggagttccagagcaggaggatcacttgaggtcaggagttccagaccagcctggccaacatggtgaaaccccatctctactagaaatgcaaaaaaatttagccaggtatggtggcaccagcctgtagtcccagctactcaggaggctgaggcaggagaatcacttgaacccagaaggtggaggttgcagtgggccaagatggcgccactgcactccagtctgggcaacagagtgagactctgtttaaaaaaaaaaaaaaaaagaattttgggccaggcgcagtggctcacgcctgtaatccctgtaatcctgggtggccgaggagggtggatcacctgaggttgggagttccagaccagcctgatcaacatggagaaaccccgtctctactaaaaatacaaaattagccgggcatgttggcacatgcctgtaatcccagctaatcaggaggctgaggcaggagacttgcttgaacccaggaggcagaggttgcagtgagccaagatcacgccattgcactccagcctgggcaagaagagcaaaactccatctcaaaaaaaaataaataaataagatttctgcacctaactcaagtgattcagcagaaataattattattatttcattattattatacacacatacattaaaagagatacaaagccaagtctggcaaaatcttatcagtgaacctaggtgaagagtggataaatgggttgctcattgtattaatcttgcaaattttctggaagttttaattttttttaaaggctagggaaaacagtgtatgtcatagtttaaatttcttgagtgtgataaggttattgtggttatgtatgagaatatctttgttcttaggagatacatattggagtagttaggggtgaaatgtcatgctatctgcaacttactttcaaatggttcatccaaaaaagcatataaatatattttaaagtatatgtaaagtacttaaatatatgagtatatatgtacaagtataaaataaatataaatgcaaaaaatggtgggtcaagtgaaaggtagagggtgttgctttgaactattcaacttttctgtggctttgacatttttcaaaatgagaagttggggaaaaacatttagaaatatgtaaatatattaaggatacaaaataaaatttaaataattttacaagttaagaatcatcctggaaaaattacatcctgttacatccctgcttaaaacctcagtagcttcccactacttctaggataaagacaaaattgcctaacaagggctacaaggcctggggtggtctggcccgttcctctcctcctggtaccctactcatcaccatcagctgccccctaggctccaaccacacataaccacaccctaactacaccagaaggaaagactccctcaaaattctctctcctcctgtcctttacacatgcagctaccaaagccaaaacctcactatgagggactgagaaatggattctcatgttgtttctgctgaactgtttccctaaatctcggaaatattctctgcccgcctcccattccacctctccaaccccggccaagtctgggtaacttgcctccttagcatcctgtgtttatctcatcgtagcacctagtacccagtattgcaattgtccgctcacttgttagtcttcagtgctctgttgtctccttgaaaacagggcctgacttgactccc

SEQ ID NO: 15118 - DNA, 15857 bp, Homo sapiens
ttttttttttttttttttttttttttgtgagacggagttttgctcttgttgaccagactggagtgcaatggcccaatctcagctcactacaaccttcgcctcccaggttcaagcgattctcctgtctcagcctcccgagtagctgggattacaggtgcctgccaccatgcccggctaatttttgtatttttagtggagacgaggtttcatcatattggtcaggctggtctcaaactcctgacctcaagcaatctgcctgcatcgacctcccaaattgctgggattacatgcgtgagccaccacgcccggcccggttaacatatatcttgaccatttctagctaaagaatttaaggtgcatgtggttgggcagtagggagtcattgacaaattttgagtacagacatgccagagagcatctgggggcagatggatctggcagtgatgtgtaagtgagttggcatgggagactggaggaacagagatcaatccagagtgagggtagaaccctgacttacaagtcatctgtgggaatggaaaggaaggagtttatttgagagctaccataaaatcagaaaatggtttgattggaacagaaatggactagagtgagaggggagtcaatggtaaccccaaggcagtggttttcagattttctcaggtaagaactcccatgagattgtttaaaatgaaacttctggctgggtgtggtggctcacacctgtaatcccagcagtttgggaggccgtggcgggcggatcgcctgaggtcaggagttcgagaccagcttgggcagcatggtgaaaccccatctctactaaaaatacaaaaattagttgggtgtggtggcaggcacctgtaatcccagcctcttaggaagctgaggcaggagaatcgcttgaacccgggaggcggaggttgcagtgagccaagatcacgccactgcactccagcctgggcaacaaagcgagactctgtctcaaaaaaaaaaaaaaacgtagattcaaggtccctatccttccaaaccaagaaaaaaaaaaagggttctgattcaacaagtcaagagtggagtctggggtctatatttttaaaaagcataccagaagatttagaggaaagttggttctattcttatgaaacattactcccaaagttttcaaatctgggagacttagagggccctccatctgtaggggaaagatcaaggtagagaggccaatttaggaagtaaatctggtacaccatgttattctgaccttcagtccatctcaccattttaccctccaaggctgttaggagaattggatgtaggtggagagtcacagaagcaggtatagccattttgtattttgaggatttgtttccgttttatttttcgtcaatatttttcactgcatttttcacatcaacagagttgggtttagggttccccaggagagcaagggagatggatgggtccctcccaggggtgcgaggaagagggctacgtccagcatgtggggagtgagggacaagggcacagggcacacactcatacactgggcactggagaaggcagtcttttgagcacagacaccaaagagttaaacagtcaccacctggtacagtgttacaaaatggggagagtgaccacagggttggggcactggacgcagcatgacgaaggtgaattttgattttcttttttgttattttcacttttttccttttaacatttttttaaacattttacaaacatctaaaaactacaacacgtcacagctacagtggggtgaggggagggcaccaaagaaagcagccacacagagtagggtgggatggggcagcctaacctacagaggctattgtgtggaagggtaaaatggggaaactgaggcttctagtccctgcattaggggtccctcactcactgcccaacctctccccactcagaggagctgccaggagggcccctgcttcctgcctctgccccagctctttgtgctttttgatctgctggtttgaccagatgcctggtttctttccctcccctgctcccctccctgtgaggggacaggtagggagcatgggagggcagctgtgctattcccgcctgtgctgtagtgggtggagcctctcactccagaggaggcctctgcttcttgaggagggaaggagatgggccttgtcggatgccctcagatctccctagactgtgggactcttatcccaggctggcctagggctcctccatcccaggctcaacacagaaaccagattaggggaggaactgtgggaggcagggttgtgtgtgcatccgctgaaattacccttggcttatatttgaggacagtatagtgataccccccgccccatggcacatgcacacacatatgtaagtatacatacacattcacacacagtcctgcggagctgcctcagaacttaatctattaataaataagaatcagaaagctaatttcataaaattcaggcttcatatttgcagcccaaattgagaggaaagtggaggccagagggctgaggtttattgcttctcccccagcatccaacaggagatgtgagagggcacccgaggcccactcttcagactctaagaagttcttttggtccatggtctacaccagagccccagcccctagcataattgcatacctgtggtttcaccagggcctaggcagagggaatgatggggaaggcaggaagcctattctggaacccctggaacagggaagcaagggcccctctctaacagggggagaaggatggggctcagccttctcttgtgcaaagtcaagggcagtgggaaatggggagtacagcttcatctcaaaactgggatgaaggagccttccctgtagtccctgcccacggggtttacacacatgcacacgcacacgcacacacagttaagacaccaaacacggggagtggggagtgagggctctggaggtcaggatggcagggcagggaggggaaggaaggagttgttggtctcacagtgtgcctgccaatcccaaagccctagagaccccttcactgcagcacctgcccccgggtctcaggcagcttcagggccagagagctgccaagggcaagggcagctgaggcaaagaggatgggtgcagccttggtgattcccacgaaggatgtgaagatgctgatccccagcacagctgccagcttacacagggcattcaggaagccaaaagctgtggtcctgctcaggagtcccccagtgcagcacggcgcaaggtacaggagggaggcaaaggaagagtggagggcagggaagtgaagtccaggaagatgcaggcagtgtccaagagggagagagaaggttggagagatcagagaggtaaaggatgtacaccaggaatgtaaataaattgagagacaaagggaaaggagaccaaaaattgaggttaacagttaagactttgaggagtagatacaaaagctaccagatttttttttcctttttttttttttttgagacggagtcttgctctgttgcccaggctggagtgcagtggtgcgatctcggctcactgaaagctccacctcccgggttcaagcaattctcctgccttagcctcctgagtagctgcgattacaggcacccagctaactttttgtatttttagtacagacagggtttcaccatgttggccaggctggtctcaaactcctgacctcaggtgatctgcctgcctcggcctcccaaagcactgggattacaggcatgagtcaccgtgcccggccaaagctaccagattttagaggagaaaatggaaatgtatatcctctcacccctaaggatgctcttcccattcagccctccttcctcaccccacccctcccctgaatccactgccctgcctccaacacattccaactacctcttgtctgaggggtagagttcaacagtcaacacgtccagcgcattccaggatgcaatgctgaccccgccaaaaaggcagagcagagcgatcatggccgactcactgttcccaaaagacaggaagaagcaggagacacaggacatcacgctggagccagctggagccaggagaggagagagcaacatgagcctggccacagtgaaacccacccacagcccaccctgtcccatcagctggctttcagatagcccaggatgagacttgttccgaaggtatccaaccaaggtatccaaaaggaaggcttttcactcctcctcaacctcccttataattgtttattaataatatcagtaaccatcatttattcaatgccagccatgggccaaggcaattgatgctttacatgcattgatctagcacatcaaccctatgacacaggtactattatcacctccattttgcagaggaaacaaccaggctcatagaggtaatttgccagaggccagaggcaggtggtggagctgagattcaaaacccataacctcaaagcctgtgccctaaccacttgcaattctgcttacctcctttacccccagagaagcttctgtgccagtccccaccccatcctgcagcaccccctaaacagaaaacatgagagaggaactctctgaccaatctcttccacagcccaaggtgagaagcctgttgactgcctcccgcagcccctggcccctactatcagatctgactcagcctctcccccttaccaagcattctgagcctgccgatcttgtccatgagcagggcagacacgatattcccaggaagcactgccagtgtccccaggaagctcacaaagtataccatgtaggcaccttcgcccgtccctgtcacgtctagcgggcagccctccttgttgtgcaggaatgtactgtttatcagacggctgttcacaaacttgtactcgaacaggtctgtgggcaaaggccaagataagcaggcagtcatagcagatgggagagggaggctgttacggcttatggctcagggctctgcatgtatgaaagttagtaggaggggctctcaaaattattcacagtgctaatcacaaaacatcaaataacatcaccatgggaactagggatctttagagcagaaaatgaccatcatctgtccaacagtgtgactttgtccaagttctcccattaatagtcttagctgcttattcattctttctgtccgtgctagctgactataagcagtagcgatgccgtggacttaggaaatttttctgagaaaaacatttaaaataataaaaagtcctatccattgttgttttcctgcaacatggaaaaagctcgcccagtatgaggtgggaaatttcagtctagctcacaaaaccagcatttcgtgtgcatatactgaagtttgagaatcactattaaaaaggagtggattcatgcaatgatccgcaccaaataccccttttattgattgtttttctttttcccaagaatgctattttggatgatttttaccttcttcaaaagtgcattaattttacctcactgagttataatttcagccaaaggcaaataaacttgatgtttttgtcagatattctattacaggaaaatgtccaacatccattagattttcagaattattggtggtagctatcaggcccctctgccaccttcccacaggggtccagggatctcagcttgagaaccctaagatagtgaatgaaaaaggttccttctcatcaaggtccacccaaccctttggtctgacacccaccagccaccccgccttaccagtgttatagaacacagtgttgatgaatgtgcagttgcggaaaaacgtgttgctggatgtgacatcctcaaaataacactcttcaaacagggaatcctcaaaggacactgacttgagccgcagcccaatgaacctgtaaggccaggatggtgaaagacactcccccgtcatcctcatgccccctccaagactcactctttagcgaagtaatgggaagctgggcattgagaagaaaccacaagtgtttgccccccaaatgtcttgtcttgaacccctagactcataaaagagacgaggtagaaggaacagggaagaagtgaagtttaaaagtccccacatacttgtcattgaagtactgcccgcctcggtggatctgattctccaacgtgaagttaaaagttacatgctctacgcgctccccggggaacactttggtgcgggatgcgtagtccactgcctggagatggcggatcatgtcaggaaaccagacggtcaggccatagtagctgaagagtcaaggacaatggaaacagacaacagggcttcagacaaggctcagagattagaatcaggcagaggagaaaacggaaatgtgtatcatctcagaacaagggagaaatggagtcaacctctgttaggaccttgctcctctccagcctcaccagcttctccctgctcctcccttcaacagttgctgcgctcctgggggacttcagggtctcgcacagcagccactatactttttcttacctcccaagcatttgcttttccctctgccaaaaacactcttctccaccccagccacccccactccacctgtctgactcccattcacctttgaggacttaggtccccaccccagcccaagccccaagtgctcccactgcccttcccccacccttctctcatcaccctgcttcatagcaagtttcgtctcacttcttttttttcttttgagacggagtctcgctctgtcacccaggctggagtgcagtggcgcgatctcgactcactgcaacctctgcctcccggattcacaccattctcctgcctcagcctccagagtagctgggactacaggcgcccaccaccatgcccggctaattttttgtatgttagtagagacggggtttcaccgtagccaggatggtctcgatctcctaacctcatgatccgcccgcctcgtcctcccaaagtgctgggattacgagcctcatcgtcctgcttcttaaccaaaacataaactccaggaggaccttggaccacatctgtttcatcccagcacagaatagaaactgaatcctggtcagcctacagtacaagtttgttgagtgaactagcgaagtagaggagctggctgcaggatcagagggggtctgcatggcaccttccctcatcgcttgtcccctgcatctccattctccccacctctctcccagcccacacaccaccacaaccaccacacatcacccagcccacccatctcctcacctgaatgacatggtgaaccacacacccatcatcatcagagtgatgcgccgatattcgggaccaaaacaggagagaaaattcccccaaacctacaggggaccagacaaagtcagaccttgactatactaagttctagcacccatagatccccacttttctgccctcccacctcccttcagctcacccatcacccacacacatagacttcagtcctgccttcttctccacttcccccactcccttctatctaccaccccgtccaccattacctgcccccctaggctcaaggcccggaccccccagcgctggtaccaggtccctgtgtccgactggatctcaatcaattcatcctcctgatgaatcgtcttaatgtgggttacctggggtcaagagaaggggtgggcagtcacacactctgtgtttcccaacatcggccaggcgcctcagtttcccctgcattagcaaaatgggaggcaggaggtggatatgataccctgaaaatctccttacggtagagtgtggtctgaggtggggggtactcagagaggggccaggtaggggctggggctgcagggcgtggaggtctgagtcgggagggctgtggcttactgagaacactcgctcaggatgtcctttggctcgcatgttggtatcatggacctgcttcagcaccatccaggcctcatcatgctttccattctagagccaaagacacaatccccacatccaagtcagcccctacctgacccagagttatagaccccctccctcccacctggcttctgtagtcacaggacactaaatggttcccagccctcaaccccaccaccaagccctgacctatgggcatgcactcaccactctgaaagagccccaagctgaggtatagcaagacaatcagacttgggcaagagctgcgggttgggggtggggagtgttgtccaggggaaaaaggcaagcacaggtcttgggaattccatagtacagaggaatgtaaaaaccaaaggtaagggaaatgatgggcaagcatgtagtcaaagacctaatcctgctggggttaggaggggaaggtatagggggtgggaatgtctcttgagctgtaaatgcaggacagggccaaggcccttccctgcaaaatcttaagtcatccatgggtgaagaggtcccctggtttctccacccaagaacccctcagggacacattccaaggcaaagaatgcaagataaagtcccctggagagtggactctgtgaggaaggcaggcagtcaaacaggatcaaatcaaactccagttggtgtttgaacacagaagcccctgctgccgtccacactccacagcccgcaccccaccccaccccatgcagctcagccccatcacctctaggaagaaacgggggctctcaggctgcgtggtcagagccccaatggcaaacacagaaggaaaggcgcagacgaggacgaagaccctccagctgtggaactggtaggcagaacccatctgaaaactccaccctggtagggagaaagtgacagcatcagcagagaggccagaggctgggggaacccaccacagggagcacagaagaagagggaggagggagataacctggggtggatttccgggggctgctcaccatagtgggggatgatggcccaggccatagcagctgcgtacacgccaccaatcatccaaaacatgcagagccagctcaaatgctcccctcgtttctcctgggccagaaactcggagaaataggagaagacaatggggatggaccctccaatcctgaagtgcatttcaagaattcagcattagcaaatggccatagtcctgatcccctgccccactgctctggaccccgagccccttttgtcttccaggcttttgaagagactccatctcacacataaagccttacaagctcccatgtgggccagccatcaagcacccatccttgggaccatgggaaacaggcaagcgagtctcagggaaagggaaagagcaaatcttaaatcttgaaaatgaattacagagttggaagggcgggaaagtaattgcagaaaagagaataaatctccagagaaaaaagacaagccaaaagcctccaagggcagatgttgtgggaatggccagaaaggagcttggagttgaagcagagtaagcgggcctgccatgcttgcaaaagtgaaggggcagtgcggacaaggcgtcagggttctggcaggtgtgggtgttagcaaggtttgttgtgtaatgcaggaaatgtgtagactctggtagggggtaactctgggtccacaggagcccaggggtggggctgaggcccactaggcctctttgtggaggcaggctcaaaaatggaactagaggtggggtggaggactcaggagtgggccaaggaacagcattctggacagcagcagacaggtcctgggcagggaggagctggcctgaagatggctgggggagaaaggaactcattcatccgttcaactcacacagatttaaggtgcatttggtgtgcctggcactgtgctgggccctaaagatacaacagtgaccaaggcacagtcctgccctcaagggacttaggaagtgtacactcacccaaccccagaaagtaggcggcagaagaggaaagtgccgtaaccctggacaaaagatgagaagaaggcgaagacgctgttgactgagagcgagatgagcagacactgcctccgacccagccggtcagccagacctccccagaggaaggctcccaccatcatgcccaggtagacgatgaggcctggaaggaggaggaaaacaggcagagggggtgtgagcagacacaccttaattctcccaggagatgagcactgagggagctgaaggatctgaaaaacttctagaaggtaagtctacccagagattagagcaagtgagagaaaatgaatggtgtaagcaaagatagaagatcatctctgcaggccaggggttcaaaggcaggaatgaagatatgggagaacctgcaaactctccactctcttcggtctgtctcatttctcactctgacacacacacagtgacacctttacccctggctcactttgaaggaggaatgggtgtgcctaggatcacagaccaccccagggtcctctctattctccctgctttgatccctcaaagcagcaggagagctctcatttgttcctggggaaaggggctccaattcatttcatcttcccaggaaatctcccacacaaaatccatcctttactccttccagtctcaatatttctggtccaaaaactctcctgtttttcactgccttcataaaaccaaagctggaattaatctttaaaatcatctactccaaactttgcattttcccatgcccaaaccaagccccaggaagaagagacctgtccaagaccccatggcaatttggtggcagagtaaggcctcgattctttctctgtgagtctacggggttcctcctcagagtccctgtcaggaaaggccatcaaagactacatcctgtcccctggaaactcccatctgagtgagagaaagtctaaccagcttctctggcagaagatccaggaccctccccccctcccccaaccaccccaaactgactctccccatttataccaaggagtttggatactggcttcttgttccccaatcagtgaaagggaacaggataaccagagggaaagctatgaagaaacattaaatggtagggaccatcctaccacagccacctcctgcagaatgaagcagaccaccacccaaccactggcccaagccccagtccagctgccctcccgcaagcccctctgtcacattcaacttcaccctgacccaaggccaagaagagggagtgtgtgagggaagagtgtgcagaggaaccctgagccctctgggaacatcttgggtgcagggtcctagggaacccagtggtaaggacaagagcaatttccaggagcaaggaggtttccagagtttgaggggataaggctggagccccccatgtcttacctagcatgcctttgttggagtcggacaggcacatgtctttctcagcgctgggcagcacgaagcccaccacaaagacctccacaccgtcagccatcagcgccagaccaagcacaaaatacagtgtccactggaagcggccgtggccacactcccgtaggatggcttcatactgttgggccagttcttctcgttctttccgtcgttgtgcctccccccggcccccagggggaccctccccatcactcaagcccccccttactccagccaggggcgccccatctgccatccgctcgcctttgcccccagactctgcccggggaatgccctgatattccccttcatagatctcatcatcctcgtcatggccctcagtagcatcactggatgcaccaccttcctcctcatcctgggtcccttctcctcggtaataaccatcactgggagcagggaagtcatcatcatcatcctcctcctcaaagcgggagtacgatcttcgggaatattcgtcctggactctgtccaggcccttcaccaccttcttggccgcatgctttttgacttccttagcaatgtctttggccccacggatgaaagctgcccggtctcggaagccctcttccatgatggggcttggggcacttcactgggtcttctccacctcctgcttctttttcagctttttgctcaaggacttgtagagtcaaaaagacccctccccacagttacttagatgaagcgtgttccagtatctctgggcacaaaaaaaagagcaaacaggtcctagccaatgagtgcctaggaaggaaaaggaaagagaggagctttgacctatacccagttcagttgggtggatggggaagggacagggggagcaggggaatgggaaggggaaggggagccagattgggaggctaagccaggataactcaggaagggtcgcctgcttctcttccacaagcctctggagacctagaaaaaataacagacagcaaaaggaagttgtgagtcctaaggtggtgaagaaggccagtataaagcctctcaacccagagccccatctggaccatgtggtgcagagatggtcttctcgctttaggctcccatccacacactaaaaagggatggctatctgggctaaccgggtcactcacatagaagtccccttactttgaccttggaggcctggcctgtggaatttgctccaaagtcgcagtcacctacccccaaacccaccccagcccttgctttatcaccaatctgcaaagaactaaacaggaaatatgagaaaccagaattcccttctttagtcttgcctgggtttcttactaggggtggagttgaggaggatgtgtaagaggacaagccctccaacctgtggccttccctcctctgatggcatctgaaggcaggggcttccactgtccttccctcaggtcccatgtttacaggcttcaacaaggagggattttctctcaacatagtctaatgggtaaatgctcagcttccagagtcacaaagacatggggttgacttcctgttttggcaaatactagctaagggaccaagcctcagtttcttcttgtttaaaaaggggaaagtaagggtcgaatgatataatgtatctatgctccttaccataagtcacctggcacataaaaatgatgaataaatattaattattaattttgtggtgacagtaatatagtgaaatgccctatactacctcataaggtccccagatgaaagctatcttggatgctctttagggtgagcagcaggaagggacactggcaaggagaatcctggttcagggcaaagcacatgactgttaggggtgacctaagttgaaatcccaactctgccacttactaactgatctcagtcagggtagttaacctccctaagcctcagtgtccatctattttaactggggataattaaattgggagactgtttcttggagttgatgtgagaatgtaatctcacagtagatactctatgttagttttcttccttcctatgatgttgaaagtgggaaagaaacaggaagcagcaagggacaacaggggggtcatacttagatgctgttgcccagcatccttgcaaacagagtcccaagacacccctatctatgtttcaactaattccagtagctgggcccacattaactacctccagaagaacaagggaagatccagaaaagggggacctggaacccaagtaaagtggaggaaagatggaaagctaagaaagaggtgatgactgtccactgccaccttgcttcagaatgtcatagataggccccctttccacagatgggggtgagaatggaaatgactgtcaaatgcatacatttccaacatgaggttctaaggcctacagttgcatcccatccctccagggcctcccttcctaatcccccttaatcctttctgctcctcctccaggagtcaaggaagaaggagtccacaaacaccgcattgcgtaggaggcggatgtagaataaagggggtttgggtgtccccccaaaaaagacattctccagaggaaggcatgggatagcccccttccttcataggagcagaggaagcaggcctagattctgatcagaaatcatccccctaaaaatatcctgcctccggtgctcccacccatccagggccttcattaaaacacacacacacacacacacacgcacacacacacacacgccctggtagaagacggtaagcaatgctatgtggttcagagagaagcactggcaagcagcgccttatcccctcaggacagatgtaagcagtggaccacggtgaccagaagcagtgacccctatgtcaccttttcttcatggttcagggcccaaccatcccccatgaaagagctggaactgcggaatcccctcagcgcatggcaatttgctagctttcctctctttcctaaccaggatctcccctccagccctgaaggaggcaggacccaccaggagccatactctatgtttgttgaccctatttccccctgagaggggcacgtagggcaggaaagccttccacaaccacagcaggatatgaggtctcaacagccagcttcctcagggccagcaagcccaggaggtcaggagagaaagaaagaagacaaattctttgagctggtgaggaagtggtgctatttttagcccccaaaacagcacagggtggctaagcctgggggagtgagacaagacttggagaggtggaggttaaaggagacaaggttcagggttacaaggtcctaggctggctgacttcacctgacaggaaaaaatgtgcccaggagattttctgcagagggtggagacaggcaggggactccagagcaaatgctttctttcagaacagctcatccagccctgggtccagaaccccccaccctcccagtcaaagcccctgactttggggtccacccagatccccaggccttcctagctcaggtgacaaggtcattaaaaagcaatcacttatcaaaacgtccgcgggggcgggggtagaatgtgggaggtgcgggagcaccccttccccatgacagcccggtcatcgaacttcagcccccacccaggaccatcaagactgcgcctcccctccccacatcctaccaaggttaggaagataggagcacccacagttctgagggataaaaatgagggtgtcagctgagaatgcacactgaggaatacggagaggcagagagggggacgcagggagagacctccgcatgcacagacatagagaccgcccctatcagcatttgcagcgacccccccacaccccatcttgcctcagctccggaataagggaaaagcccccagaactgactaaatccctgctctgagcacctcctccacccttggtcctgctgctagacaagtgtccaccttcactcaacatcccttccccccaccccggagcaactgccgccagcccccgccatccatgcccccaacacctggcggctctacatctctgtctccccagtatttccattcttcactccccttccctccatccttcacctgcccttcttcccctgccccccacccacccaagtccaggcgtgcacactgaggcagcatccattctccagccccagccaaggtcatttatcattcatcctgggggtggggggacgtcaaggtgaggaggggataggagtttgagggaacctcatcccacctcacaaccccaccaccacgttaatctccgaaggggatagtggggacttggttaaggtagagaaaaacacccctcctccccattcaccaatattatacatatgcgtgtgtgtgtgtgtgtcctgaagagcacaactgaaataaatgtccatccccaaaccaccaccaacccaccaacccccctcacccctagagaggggatcgtcaccctccccataagcaaagcatcggaggataaaatggctgcaaggcaaggcaaagatgcttctgccaggggcggggaggaggtgagcgactgagaaaggggtctcacctggtctaggttccccgggtaaggagtcccgggcgaggacgggggtcccggccgcgggcggaggcggcagcggcgactgctcccggcaccagggaag

SEQ ID NO: 15119 - DNA, 3900 bp, Homo sapiens
attttgatagatagttttattataaaaaattggctttttgattatggaagctaataaatcccaagatccccaagatcttcagggtaagttggcaagctggagacccaggagaactgatgatatagttccagtccaagttcaaaggcctgagaaccaatggtgtagttccagtccaaaggccgagtctaagacccagatggagccagtgtttacttctgagtctgaaggctgagaaaagccaatgtccgggtctcaaagcagtcaggcagaaggaagtctctcttactccggagtgggtcagtcttttgttctagtcaagctttcaactggttggatgggacccacctatattagggagggcaatttactcagtctccaattcaaatgttaatctcattcaaaatactctcacagaagcacccatatttggccaaatatctgagcaccaatcctctagaagttgggacattaaccatcacaggccgtgcgtggtggctcacgcctctaatcccagcactttgggaggctgaggtgggtggatcacctgaggtcaggagtttgagaccagcctggccaacatggtgaaacccccctctccactaaaaatacaaaaattagccaggcgccattgtccacgcctgtaatcccagctactcaggaggcggaggcacaacaatcacttgaacccaggagacagaggttgcagtaagccaagattgcatcactgcactccagcctgggcgacagagtgagactccatctcaaaaaaaaaaaaaagttaaccatcacaggtagagtttaataggctttatctctgaaacttagtctcaaacagtccagaaaataattatatatttgtagataggtacatacaaataaaacaaacagtgaattgttaatatttgggtaatctaggtatcaggataaaggatatacaggaattatttgaactgttttttttaactttagatgcacaaaccttgtaattatccttgacactttccctcccacaaccaagccattaccacaccctgtaggttttactttcctaatatacatcctgtagccacaatttctctccatttccaccaccaccaccaccaccttggtccaaatcatcatcatctctcacctagactgctacagtaacctcccaacttgtctccctgtttccactcttgcctcctctacaatccattctccaccctgaagccagtgatctttgcagaatacaaacttaaagtcagctaaatgcaatgcatgatccttgattggtttctgaaaattaaacatttataatgtttacttagactgtgctgctattacaaaataccactgactgggtaatttataaacagaaatgtattttctcacagttctggaggctgggaagtccaagattacggcactggcaggtttggtatctagtgaaggccagttcctcatagatacgccatcgaggtgaccttacatggcagaagggacagaaggggccaacttaccccctcaagctctttcaaaaggcgttagtccattcttgagggtggagccctcatagccttattacctcctaaaggccccaccacttaataccaacaccatggattaattttcaacatgaattctggaggagacatattcaaactatagtagacaccaatgagacagttggggaaatctgaatatcaactgtatgtgattatagtattgtatgaatgttaaatgtcttggatgtggtaatggtattgtggatatgtatgaaaatgtccttgttcttaggagatacacattgaaagtacatagcaattaagtgtaaagaattttgtggggccaggcgcagtggctcacgcctataatcccagcattttgggaggccgaggcggactgatgacctgagtcaagaccagcctgaccaacatggagaaaccccgtctccactaaaaacacaaaattagccagagtggtggcgcacgcctgtaatcccagctacatgggaggctgaggcaagcaaatcgcttgaacccaggaggcggaggttgctgtgagccaagatcgcaccattgcactccagcctaggcaacaagagcgaaactccatctcaaaaaaaaaaaaaagaattttgtggctgggtgcagtggctcacgcctgtaatcccatcactttgggaggctgaggcaggcagatcacttgaggtcaggagttccagagcaggaggatcacttgaggtcaggagttccagaccagcctggccaacatggtgaaaccccatctctactagaaatgcaaaaaaatttagccaggtatggtggcaccagcctgtagtcccagctactcaggaggctgaggcaggagaatcacttgaacccagaaggtggaggttgcagtgggccaagatggcgccactgcactccagtctgggcaacagagtgagactctgtttaaaaaaaaaaaaaaaaagaattttgggccaggcgcagtggctcacgcctgtaatccctgtaatcctgggtggccgaggagggtggatcacctgaggttgggagttccagaccagcctgatcaacatggagaaaccccgtctctactaaaaatacaaaattagccgggcatgttggcacatgcctgtaatcccagctaatcaggaggctgaggcaggagacttgcttgaacccaggaggcagaggttgcagtgagccaagatcacgccattgcactccagcctgggcaagaagagcaaaactccatctcaaaaaaaaataaataaataagatttctgcacctaactcaagtgattcagcagaaataattattattatttcattattattatacacacatacattaaaagagatacaaagccaagtctggcaaaatcttatcagtgaacctaggtgaagagtggataaatgggttgctcattgtattaatcttgcaaattttctggaagttttaattttttttaaaggctagggaaaacagtgtatgtcatagtttaaatttcttgagtgtgataaggttattgtggttatgtatgagaatatctttgttcttaggagatacatattggagtagttaggggtgaaatgtcatgctatctgcaacttactttcaaatggttcatccaaaaaagcatataaatatattttaaagtatatgtaaagtacttaaatatatgagtatatatgtacaagtataaaataaatataaatgcaaaaaatggtgggtcaagtgaaaggtagagggtgttgctttgaactattcaacttttctgtggctttgacatttttcaaaatgagaagttggggaaaaacatttagaaatatgtaaatatattaaggatacaaaataaaatttaaataattttacaagttaagaatcatcctggaaaaattacatcctgttacatccctgcttaaaacctcagtagcttcccactacttctaggataaagacaaaattgcctaacaagggctacaaggcctggggtggtctggcccgttcctctcctcctggtaccctactcatcaccatcagctgccccctaggctccaaccacacataaccacaccctaactacaccagaaggaaagactccctcaaaattctctctcctcctgtcctttacacatgcagctaccaaagccaaaacctcactatgagggactgagaaatggattctcatgttgtttctgctgaactgtttccctaaatctcggaaatattctctgcccgcctcccattccacctctccaaccccggccaagtctgggtaacttgcctccttagcatcctgtgtttatctcatcgtagcacctagtacccagtattgcaattgtccgctcacttgttagtcttcagtgctctgttgtctccttgaaaacagggcctgacttgactccc

SEQ ID NO: 15120 - DNA, 1093 bp, Homo sapiens
ctcttggaaaaaaattatgttagtcttctataattatagaaataataaatgttcacaatagaaaaattgggaattttagaaagagtagaaaaagaaatccctataatatccccacccaaaggcagttactattaaatttgggtatatttcctaccagcattttttctcatgcatgcatttcttttttacgtagctgtgatcatgaaaacaagataattcgtgtcctgtgttattcatttgacatattccataagtaagctccattatagaaagtaacttaaaatgatgttgtatgtttgtttttgtttgtttatgttttaataaagcatgtggattacttctataagacgaaagggaaaatgtagatcctatgcacaagtatttatttccctccaaaccccctttttataatatgtattgttgattttatagagtgacctgatcagtacatgtaggggctcaaatcacagctattctttaatacttcgggttacttcattgctattattgtttgttactaatatgtaagatgaggaaaagacaaccttttggtgggtgttgggactgggagggagggcattgaggacagatgaaccaaagctggatatggaaggaaacccaacttcataccaaaaaaaacaaaacaaaacagaaaaaagaaagaaaaaacccgtctagaggccagttgggaaaagaaggaagcagaaacaaacaataggatatgaggttcagatttctttaccaagaagacacagatctttcatgactgtagacaagaccgagagagaaacaaagcctccccaccccgaaagtcccctgaaaggaaaaacattgggaaaagggaactggtaggaaatgactggaagaaccaaagaaacagtcctcctaaacagaatgttaggtggtacgtaatacacggttttcaggatctccatttgtgggcatactgggagagtgcaggcctacatgtgctagtggtgagctggggggaaatggtgcagtcaataagtgctagtttggcaaacaaccagataatagaactaattaggttagtttctcttcttatattaaccaaaagttcttatattaacta

SEQ ID NO: 15121 - DNA, 312 bp, Homo sapiens
ggccgggcgcgggggctcacgcctgtaatcccagcactttgggaggccgaggcaggcggatcacgaggtcgggagatcgagaccatcctggctaacatggtgaaacccggtctctactaaaactacaaaaaaattagccaggcgtggtggtaggcgcctgtaatcccagctacttgggaggctgaggcaggagaatggcgtgaacccgggaggcagagcttgcagtgagccgagatcgcaccactgcactccagcctgggcaacagagcgagactccatctcaaaaaataaaaaaaataaaaaaataaaaaa

SEQ ID NO: 15122 - DNA, 21100 bp, Homo sapiens
ggcagctcctttagcggcagagttttccgagtgaccttcttgatgctggctgtttctctcaccgttcccctgcttggagccatgatgctgctggaatctcctatagatccacagcctctcaggtaggctgccccgcagtcctcaggaggggttgcttgacaaaatgtaataggctgaaataatttccaaggaaaggagggtgattaaatcaatctgatctgaaaggtaagttaggagaaatagagttttgtgatttctttagtacctgggtttttatgctgaattagatgttactcaggaaatatgcatggtattttccctgtcattgttttaaaaaaactgcatcaaccaaaaacaaaaattcaaaattagagaagcttaataatcattagacagtcaactataattcatttcaggtagcaaaaacacacacaaatggagcttcagttacctcatttaaattttgtaagtaactgattttctacaaaacccataattagtgttctttttttcctaagttacctttcaccgatagagatctatgagtaatgcagtccattataatttgaaaaaactattgtatatgtaaagccccctgaaatagattcatgtttataattatagtgggatagagccaggctctcatcagtgtgacgatctatgacttccatgttgacatagttgcaggagggttgtgcagtctggttcagtaatttcctggttccccttgcaactgctgatggggtgaagccatctgaagcttattttaaatgagttagtccaggtaaggctttaaaaacttcagacaagaattatacctagttaaagagtgaatataacatactagctgaataatgtagtgttttatccataaaaattaaggctttatattggatccgattcactaagaatgtagaggacacggttctgaccttagattgacatgtgtagctgagtgaactttttgttgttggatttagaatagtaaaggcacaaggtgctgtaaacacacaatttgctcatgtaagattgagaatgggtgaaggactggggactctagtccgctccaagagtgtcagctctgtaattcctggtgtgccagtgggtcttcagatggatttttctgcctgagccaggcctgaggacatcctgtctccaaaggaggggcgtcaggggtgggtggcgggggggggtcccctgatgtgttgagggaggggcttctctctttctaacccttctttacagagcaggatggctcattctagccaaagggaaactgacctgggccttcttagatagtccagttggctaaggtgggggagtgaactgtgtccacagctggggattagaagcttgggttggggggctggccttggaaaaggaggctgaggttgagttttgagttggagagagaggttggagcctcagtgattgaagacctttgatctcaggaaagatgattttatgtgtggaaagagtggtgaagaaatgcattgggaaatggggtatgtggccctggccagacactgaaaggaagcagagcctactggggattggaagttgtttgtacaaagtgagttctatctgttgagtagaaaagcctgatgaggaaggaaaggaagagaagcagtggaaccgctgcagccaacagggacctctctcctgggctcagctttcggaatggcagtggaaccatcacagccaacagggacctctctcctgggctcagctttcggaatggcagtggaaccatcacagccaacagggacctctctcctgggctcagcttttggaatggcagtggaactgtcacagccaacgggtctctctctctctcctgggctcagctttcagaatggcagtggaaccatcacagccaacagggacctctctcctgggctcagcttatggcattggaatcacagccaacaggggcctctctcctgggctctgcttttggcatggcacactcaaaaacaggaagataggccccaaaatgcagagcagaagcagaagcctggtacatgacagagcttggtgtgtctcatgcaagaacgtggccacaacacaggccatgccccatgcacgccatcccagcgggtgctgactcagctgcagccctctcagcccacagtcactctgtggaaggacatggtttctctccagaagggaacaaaaagtttatttttcatagaaggatatgaatgtttctagtcactgaaaaaatatcagttaaagtcaaatttatggtaaaaaaaaatagagcagcattttggagaatggatttggttgctataattttaaagaccaacagaaagagtaattctactgggagttgaaagttgcagtactgttagaagtacacattttactatcgggtgaaactgtcaaactgagagatattaaaaaatagcaacaacctttatgggtggtctgggacatcaagagcaaatagaagcactgtataaaactcaggcagggccaacaggagacccgctggggagggagagagcagtgccccacaccctggcttcctgtgttagggagagagatgtgggggacctcagagagctggttctcagaagtgcttaggaaaacctttgtgcagtctgtgggtcacagtgggtcacttctctgcagttgagtattactgcattagtgcaggctttcttcacttgtgccagccatccgtgatcatacagatgccctgttactctgttcacatctccccacgttgtcacagggatcttgaaaactactctgtacatgctataggaatcaggatgtcatatatgctgtgtctatgacagccctctaatcttcccagaaagaagggaaagtgactttgcagggcaggtttttggcaaagccctgcagccttcctggtgattttgttctcaagtactgaaaccagctgtgtaatagtccagactggaagagcgaccatccttctctttgtccctccatactcctggtctgcctgttctctgattttttagagatttctaagtgtggtctaagctctcacgggagtgatgtagtatcctgggtagactcccaaacacccgtccatcagctgagtggccgtttctgccccgtctgctggcctgatcctcttgaccatggtggccctgcgctgcctggcgtgtagaggtgatggaggccgagcgaagctggcagctctgcttgtcatcgtggcatggcctcttgaccatggtgaccccacactgcccggtgtgtagaagtgaccgaggccgagcgaagctggtaggtctgcttttgtcattgtggcatggcctcttgaccatggtgacgccacgctgcccagtgtgtagaggtgacagaggctgagcgaagctggtaggtctgcttttgtcatggtagcatggcctcttgactgtggtggccctgcactgcccggcgcgtagaggtgaccgaggccaagcgaagctggtaggtctgcttttgtcatcgtggcatagcctcttgaccatggtggccccgcgctgcccagcgtgtagaggtgaccgaggccgagcatggcctcttgactatggtgaccccatgctgcccggcgtgttgaggtgaccgaggccgagcgaagctggcagctctgcttgtcatcgtagcatggcaccaattgccccaggtggggtttcccttccttcctcttttgctgtgaagagagctttaaagaagctctttttgctgttgtcataaacttttccccaacgcttagctccttcctgttcttgaattctctgccttgctggaggcaggggacaggggataatcggaagatattcctctctactttggtttcctccagcagtgctcgttgggagccttctgtgtgccatgttgggtgccagatgctgggaatacagtagagaaaaacacagaaagaaatccctgatctcatggagcgtatgttctagtggggacaaacagaccataaacataacagaagcagatcacacagtgcatgagaagctggtgtgtgctatgaggagcatggagtagggcaggggcctgggttcgggggaggtatcggatatttagttgggtggtcagagtgggcctcctgggtgggggatggttgctgttccaagtggagcaaagagctggtgtgaaggccctggatagggagatgctggtgtggttaggacccagcagggaggggctggtgtgagggatgcagaaggcacaagggagagagggggcaagaaggtgctgtggccaggttgcggtgctcagaggctgctgccaggacttggctctaggtgagagggggccattgtggggctctgaatagaggaaggtcatgatccggcatggctgctggattgagaatagactacaggggtcaagggagggagcaggggcgaggcgagaggatggtggccccagccagggttgtaaggaggacatggggagacgggttcaatggtgtcttttcaaagtggcctcagcagaacttgatggtgggttgggaggcgtgacatactggcatgtggatgggaaggacgagtagaggcaggagtttctggagccgtgtctgtgagtagaagggctccagggcccagctcaggctcctgcttcaggaagagcctggtgggcctcgagaatatcagcgggaggtggcgtgccctgtgctggaccatgggacggtggctccagtcccaggaaggtctccccttgctccttccatcttctctgtgaaatacgaggccgggtcatcaggtgtgaaacgtgggcactgccccccaccaccctaggtagactccagtggctgtagggctgtgagtcacaggggtgaggaggtccagctgccctgaggcattggatgggggtggggagctggggaggctggaggatgggtgggcacaggcctcaggatgctctcaggtgacaagattgctgaaggtcttgcactagcacatttatatttttatatttcttttgtaccatgatgttttctgatatcctagaacagttttttcttaacccttgtatttctggcaactgaggatgttgttagaaagtgccatctttatcaaagaactgagagcaggtgctcggtacacattttcttcacatgtgtatttatagacagatctctggaattgcattattttgcagcttcaaagaacccccgctcttgcttggtgttctgcatccaaatacgaagctgcgacaggcagaaaggctgtttgaaaatcaacttgttggaccggagtccatagcacatattgggggtaagtctaagcttgggtggggggggagccttccaggctgtctgttgtctgagggggcgggttctgtgggagcagctgcagtggcacgctgcccctggactggggccctgcacatccttcttagctgcggacgtgggacttggccctcagacatcacatgggaggccctagtggctctttctgctggtctcatctgcccagtttgcatgccattttagcactgggtgattttgaattcatctctatggaacactttgttgtgctcaaagtgttgtgaaaggaaaaaggccaaatacagatactgatttttagttcatttatcaaagttaaatagctatttgacagcacagtatttcttagttccatttgctttgtatagatttcactgtgatgaagacaaatggttctcaatatttccactgtttttgtctgactgtttgaaatctcaccttgatgggtacacttaagggtaaccatctgcatcacacttgcccatgcctcagaactagaattgggtctggttctaatacttgcatctctagcaaccttgaacaaggcattttctgtttgttaaaatgagaattaagtttagtattgggaaggcacagatagtcacagatagtttaaaacttaatctggtatgggcttgctgagcagcttctttggaagtgccgcttgttattctgaagcacactgttctccaggcagtgggtggctgtggatatgtgcacacagggtgcttctgttgtgctctcaaggccggtcagtggcctctcttctagtgacgtttgaccagcttctcttgcctgggccctgttatttgacacaggccccaaggactggtccatttctgcagttggtttgttttcttggctgtcaaagtcaaaattgtttcaagaagagtaaatatcatgatagaactttgtatttctcttaaaaagacattggcatttatttgtgtaaattttaaaagctttagctttttttggtgaaaaatcaaatcttgctctttaaaactgaaacttaacagcagttgaagtgcaaaccaatgatcttacctcccaaagagagcactttcctgtctttttctttttcactgggttacttctcattgtactttgtcaccaggtcccagctttttctctttctttgatgagctggtgacatttcttggccaggcacagtggggtcctctctggtgggtgtgagccgcagggacctgccactgctgtctctgccacctcatttggaagctgtcctgggggctggctggcaggttgctgacagtggaaggaggtactagctctggggagtgctgggagagagtaaccaccaactatagcaggctttattttatttgtttttaagtagactttatttttaagagcagttttaggttcacagcaaaattgagcagaaggtacagagattttctgaaaaagagtttttattacgattgggtgttgcatttcgtcaaatactttttctgcacacatgccatgcacagcctcccacatgatcaacatcccccaccacaagggtaagtttgttacaagtgatgtactcacatcaatacgtcaatagtactcggagtctgtagtttacggtagggttcactcttggttttatacattctatgggtttggacaaatgccatgtatccactgttatggtatcttacagggtgttttcactgccctgaaaatcctctttgctctgcctgttcattccacccttttcttttaacccatggcaaccactgatctttttgccatctccatagttttgccttttccagaatgttatgtagctggactcatacagtatgtagccttttcagattggcatctttcacttagtagtatgcatttatttaaaattcctccatgtctttccatgggttgatagctcatttctttttagcactgagtaatattccattgtatggatgtgccacagtttagttacctactgaagtacatcttggttgctgctaagttttggcagttatgaataaggctggtataaacatctgtgggcaggtttttgtgtggacctaagttttcagctcatttgggtaaataccgaaaagcataattgctggattgtatggtaagagttaagttttgtaagaaaccaccaagcgtttccaaagtggctgtaccatttgccttcccattaacaattagtgagagttcctgatgctccatgtcctcgccagcatttggtggtgtcagtgttttggattttggcccttttaataggtgtatagtggtgtctcgttgttttaatttgcatttctctgatgatatttgatgtggaatatcttcatatgcctacctgccatctgtatatcttcttggtgatgtgtctgttcaggccttttgcccatttttgtaattgggttgttcattttcttattgttgagttttaagagttgtttgtgtattttggataatagttctttatcagacatgttgtttgccaatattttctccagtctgtggcttctcattcttttgacagtatcttctgtagagcaagagtttttaattttaatgaagtttcacttattaattatttcttcatgtatctcaccttggttttatatctaaaaattcatcatcataccctaggtgttatatctaaaaattcatcatcatacctagattttctcctatgttctaggaatttgttttgtattttatatttaggtctatgatccattttgaattccatttttgtgaagggtataaggtttgtgtctagatttatttgtttgcatgtggatgcaaacaaatttgttccagcaccatttgtggaaaacactgtcttttctccattatgcattgcctttactcctttgtcaaaagatcagttgattgtatttatgtgggtctgtctctgggctaaaaattttatctgttctattgatttatttttctattcttttgctaataccacattgtcttgattactgtagctttatagagaatcttgaagttgagtagtttcagtcctctgactttattcttttccttcaatattgtattggatattttgagtcttcgccctctccatatgaactttaggattcatttgtctgtatctacaaaataacttgctgggattttgattgggattgcattgaatctatagattaaggttgggaaaaactgacatcttgacaatattgagtattcctgtccatgaacatggaatatctctccatttatttagttctttgatttctttcatcagaatattctagttttcctcatatagacctcgtgtatattatattatatttatacctaagtatgccaatcttttggatgctaatgtacatagtattgtgttttcaattccaaattccatttgttcattgttagtataaaggaaggtgagtcaatatcttgcaatatcctgcaaccatgctataattgcttggttccaggagggttttttgttgttgttgattctttcagattttctatctagacaattatgtcacttgcaaacaaagaaagttttatttctttcttctcaatctgtataccttttgtttccttttcatgtcttactgcattagctaggtcttcaagtatgatactgaaaaggagtggtgataggggcatctttgccttgttcttgatcttagcaggaaagcttctagtttgtcatccataagtatgatgttatatgtagatttttttatagatattcttgatcaagttaagaaagtttcccctctactcccagcttgctgagagtttttaatcatgaatgggtgttggatgttactagatgtttttttctgtatctgttgatatgatcatgtgattattcttgtttagattgttgaagtctctaactgtgatagtggattctgtttctccttgcagtttcatcagtttttgcctcacatattggtgctctattgtgaagcatatacacattaaaggttcttatgtttttttgaggcattgacccctttgtcattgtgtgatgctcctctttatccctgataactttccttggtctgaagtgttctctgtctgaatttaatacagctattctgggttgcttttggttagtgttaacatgatgtactttcttcatcccttcacttttaatctatatatgtctttatatttaaagtgggtttcttgtacacaacatagagttgggtcttgttttttgaataattctggcaatgtctctctttcagttggtatatttagaccatttatgtttaaagtgattattgatatattggattaatatctaccgtatttgttactgttttctattctttgcccttattctttgtttctatttttgcattctactctctttttgtcttttgtagttttaaactgagtattttatatgattccattttctctcctttcttagcatatcagttatacttcttttttttactttttgtagtggttacccttgagtttgcaatatacatttgaaaactatggaatgttttatgaatttgtgtatcatcattgctcaaggggcatgctagtagtcttctctgtatcattctaattttagtatatgtgctgctgaagtaagcacttaatgtgctgtaattttcttctaaaggatttctggcagttcttctcctttagttggatataatcaatatcagcagcagacactgatgtgaggtgaatatgaactcatgcccctaagtgctgagtgtcagcttgagtgcttcaggactggagaaaatcctcacagttctcatcactgactggtatctgctgcacccttgcttttgagtcaggttcatgcccacaggctgcttccctaggcccccgcagttttatcactgtaagttttaaggatttttcatattcccagaaattgcttctcttccatcttgagaattggcatttcctctatagggcagggggaacatgtaaacaagccctcttgtaggagaaggcggcttagtcacatttcttaggctaacattgctcttcctcctttttgtgtttttaaacagatgtgatgtttactgggacagcagatggccgggtcgtaaaacttgaaaatggtgaaatagagaccattgcccggtttggttcgggcccttgcagtaagttggtgataatccctcgatgtgtctcttccagtctttcagaaagatgttggatcgttgtgtggaactgcttttccctagaatgcctgtgggagaaaaagaacctctgaccatctagtagatggaacatgacgtcactacgagctcttcatttgccgggtggtccttgggcctcacggtgcctgatggtcacctacagtccccattttgcagctgggtagtggctgtggcccctgcttggtactgcatgggcctcgcccctcaccattttattggggtccccgtttacctttgcggtacttcagaggctaataggtgttatcacagtgctgctgtggaaaagtaggtggccttgtcattacttggatgtgtaagtgttattctgccttggtctcaggaatttcagccctgtaagtgagaatacccttaagtcattcaaattttggaaaactagagtagaagactcactgtttaaaactgatagtctatagacttaatagttatcattttttaatagctggaatgtttttattaaagtgatgtattttcataaacacaaacaacacaaaggtacaaaggagaaaataaaaatcacctgagtcttttcagatgtaattgttatgaacattttagtggttcacttttcagacatctttttgttcatggacatgcacacccacacgtatgatggaattataccctacatcagttctttaacctgcctttttccgtgccattttggcagtaagcaccctgcagtgagcatcccacagtgaacaccctgcaataagcatttgcagtgagcacccatggtcagcacctacaatagcacctggagtgatcacccatggtgagcaccctacagtaagcacctgcagtgagcaccccacagtgaacaccctgcagtaagcacctacagtgagcacctatagtgaacacctgcagtggtacttgcaatgagcaccctacagttaatgacccacaaaagcacctgtagtgagcaccctgcaataagcacctgtagtgagcaccccacagtgaacaccctgcaataagcacctgtagtgagcaccttcagtgaggaccccacagtgaacaccttgcaataagcatctgcagtgaacaccccacagtgaactccctgcagtaagcccctgcggtgagcaccccacagtgaccaccctgcaataacaccctgcaataagcgcctgcagtgagcactccacttgaacaccctgcagtaagcacctgcagtgagtacctcacagtgaacaccctgcaataagcacctgcagtgagcaccccacagtgaacatcttgcaataagcccctgtggtgagcaccccacagtgaacaccctgcaataacaccctgcaataagcacctgcagtgagcactccacttgaacaccctgcagtaagcacctgcagtgagtacctcacagtgaacaccctgcaataagcacctgcagtgagcaccccacagtgaacaccttgcaataagcacctgcaatgagcaccccacagtgaacaccctgcaataaccacctgcagtgagcaccccacagtgaacaccctacaataagcacctgcagtgagcactctacacaaacaccctgcagtaagcacctgtagtgagcaccccacagtgaacaccctgcagtaagcacctgcagtgagcaccctgcaataagcacctgcagtgagtaccccacagtgaacaccctgcaataagcacctgcagtgagcacctcacagtgaacaccctgcaataagcaactgtagtgagcaccctgcaataagcacctgcagtgaacaccccacagtgaacaccctgcagtaagcacctacagtaagcaccctgcagtgagcaccccacaatgaacaccttgcaataagcacctgcagtgagcacctgcagggcagttgtagctctaatgccatggtcttgtcttgttctgtacagcatgatgtatgggaagggatggatgagatgcttggatactgagaacagcacatgtagaatccgggaccagctaccaatccccatctgtttgtttttctagaaacccgagatgatgagcctgtgtgtgggagacccctgggtatccgtgcagggcccaatgggactctctttgtggccgatgcatacaagggactatttgaagtaaatccctggaaacgtatgtgacaatatctcgtttccttctatgaagattttagatcttttaaacaatatatgtatgtgtagacttaataggatttgttagcaacagtctactaaagactctgatatttcttattcactgaacagtactgaaaacattgcctgcaaaagtcagctagttttaaacaccagaaaactccctacccatgattccatttggtccgtatcctaatttcctcctagtatttatattttagccacagggtctcaaaaggacttattttgaggaagttagacctctttctgtcttgatttttctgtgtgtctctctgcgtcttgtctatttgttttctctctttcttctctgtggccctcccctttgtctcttcctttctgttttctcctgtagttcctcctcttctctcccctgattgctcatgagtccccttgatcaggctgtaatacgtgctgtgtgtctcagtggaggttcctgctggggaggagtccgttgtcttgtgcgtgggggcccgaacataggccctgcagcccagctgcttgggggcattccactctgctggccaccagctgtgactgcaggtcccttagttgctctctgcccagcttcctcatcaaattggggtcatagtagccctgcctgtgggattgttgcgagggtttaaaggcgatcacacctcgagagtgcttagcactcaatccatgttctttctattatttttcaaaacttactactacttttcttttctaaaaggagatgagtagaatgtcatatttctctcaaatagaactaacaaatagaactgaagcctgcctaacacttgcagtagatgttatcaagtcagttggccttagtaaaagaaggaattcctcatccttatagaaaagattctgcctttaatgaaattagtctaaaaaaatcatttaacacctaatactgtttttactataagaaggaataaatcttctgacaaatgacatggagaagtttcagtttttctttttaaatcagttaggttggttaatattttgcaattattgagaagttcctagttcaagtcaatctttttctttctttttaaacttcaggtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcggtgaggccttgctccaggtctcccatttgttgagttcaccagccaggccagttgcttcagcagagcctgttacttctagggaccaagggagtatttccagcatcatatttcagcttctaggacaggaccttagtggcttctggaggcaggtgatggatgtcacaaaatggaacaaggtgctttcgttttctctgaggaaataaaacaggccagtccgtctgagggtgcaagtctaggcagtcgagagagaccccggagccaggcctgggctttgggttgcctctctgaggggtattcctgtccagctcccaggtgagcaagataactgaccttggggttccctggaggggacactggatctgctgtggatggggaagggcccccaggggccagcctcgaatcaagtttgagcagggcacccagggcctgttgctccggggtgaggcggagtcaccttcttcaggcccataccctgaaggcccagagtgggagccagggattctcccccataaccctctgcttttggtgttccacagcctgctggagtatgatactgtgaccagggaagtaaaagttttattggaccagctgcggttcccgaatggagtccagctgtctcctgcagaagactttgtcctggtggcagaaacaaccatggccaggatacgaaggtgtgtgtgggattagctgagccatcagttactggccagagcgcatcatggccggggtggggtgggcatggaaatgggatcgacagaaatcagaggcagcagcgcaccttctgcatggcatgttaaagaaaattcaagggtgcgctttctttctcccattgcgagtcgcagtccggaagagtgtcttaaggctgactggtgcagcccgggccccattcccctgctggcagggccttggtcctcccctgacctacttcccctctgttcatactgggccctgtgcacaaaggtttcttctcagcagctgagcctttgttcatgatggtcatagagcactttccatatatatatttggaccaagaccagtttggtgcttggctaaaattttttttctgaaattgaggggctatggttcactctctgcttgggtgaatttttcagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaaggtaactgtgaaaactgttattccaagaaagaaaatggaaatgaattgaatcatatttttttgacccttatagcttaaaaatctagttctgcttgtagtatttggctctgaatgacacttagaaacacatttcattcttcatcctgaaatgcagatttaaacatttggaccctttggttcttatggttttcctttttctgggtgtttttattgtcaccctcaccatcgtggctttgggcatctgcctgcctgtcagtctctggttccctgtttctgggtgttttgattgccaccctcaccatcgtggctctgggcatctgcgtgcctgtcagtcttgctcctccatctgccatggctttgccaggccttctgtgctctccacccccctctctgcctcctcagggaaagagtcggcaggtgccctttcctcccctccctgcaggtgtggccacccctgtaacctagtcaccacagctgccatcccgcctgctccctgctgccttcttgcagcctcactgccaggcactcttctctatggagttctgccctttgacctcttaccacacccaaatctttccctttttaaaaaaaagtcacccacccccaccaatggccagccatggccccttcaacacaacagccccttcaacacagcctttaaatcttgccattttcccagtggcttccatgaagcaccccacataataactcagcacgtttacactgtggaggggtcacttgctgatgtgggcacttgtgtaatacagagatctgcttttccagcaagctccgtgtcacaggctgaataggtattttaaattgatactgaatatttgaaccgatatggaaatactagcttatggtcctggggctgacaggcagcagttgctgagtcctgttgctgggctgtgtgtctggacccctcctgggggctgcgtgcacattctcagttagactggctcacggccttcagtgatgtgagttctgtgggtcgctgtgtgggaagtcctaatctgttgagaaatctgtccttctctttgccttattggctccagagacagcatctgttcctgctgggacctagggggaggcaaaatggcaggtgggctagcacaggggttttggaggctgccagaccagctgtgggatcctgggccggggacttggactcgctgcctcaggtgctctgtctgtaaagtggaaagaataatagtgcctcatcaggtgctgggaacatttagtgagaatctgcacatagtgcccttagcgtagggtagtatgagtggtggttgtgtctcttcccctgaatagaatgtgcataccatcagagcaggtgtttttctgtttagttcatgcatagttcatttgtcatcctccacacctgcaacagtgcctggcacatgtaggtgcgaggacgtaccgttgattgagggcacagttagggagggggctgcaagcatgagggaacatggagtcttcctgcagctgggtgaggaggggtgagagggaggaccacagccccatggacttggaaagaaggttcagttttattcaaaatgtaatccaagtcattgaagatttttttgttttttgtttttgagacggagcctcgccctgtcacccaggatggagtgcagtggcgtgatctcggctcactgcaacctctgcctcctgggctcaagtgattctcctgcctcagcctcctgactagctgggactacaggtgtgtaccaccacgcttggctaattttttgtatttttaatagagacgagttttcaccatgttggccaggctggtctcgaacgcctgacctcaagtaatccacccgtctcagcctcccaaagttctgggattacaagcgtgagccaccatgcccggcctgatttttttctttttttaatttcgaggcagtatcaaagctgtggaaagagggagggtacaagggatttttttcccagcactgtttccgagttagcggctggcctaatgccctgtcactcactgcagatgcctgagcatgtgtttggcacattctccttcattaccactgagtgaaaccaggagatgcccacagctcccctgtgactgtccggtctgcaggccccattcagattttgccagttgtcccggtgttgtcctttataacaaatgattcaacccaggatcaggagtggtgtttagttgtcagctgtttaatctccttcagtctgggggatattcagctcctgtctttttttgaatttttggccttgatcctttgaaagcgtacaggtcagctgtgtcccagaatgtccctccagtagggtttgtttttcatatttagattctgctctcgcatcgttggcagcagtggcgcagcagtgaagctgtgctcatcttggcgcggctgtcatgagggcgcgataccagtttgctctgttggggtggtggcaactttggccacctgattcaggcagggaatgccaggtgtctccacctggacgtggttctttcatgtctaattactgagttgctcgcagagaggtggtttttgtaagtaatcaccagtgccatcttatggtttcccatgttcttaatggtgattatgttacagtcatcattgattttgatgctcaaattacccatctgtggccaggaggagccccttcagtgtggcttctgggcctttgggcatgtcctcttgtcttgggctagctcctcactttccagcacataagtcgttccagtttcctcttgtattgtccctgcttcagctctgcaatcggccatttctcccaggagccctggttccttgtggaggagatctgggtgctgagtgtactcgctgctttgggtgtcgctgctcccaggtccctaagggacaacgctgggagtacaagcacacgatgcatactcacatatacctgcacgcgtagacatcacacacacacaccactcacgcttatgcctgcatctgtcatctgtaaattgaaaaccatgacaacaccacaggactgatccaagttttctccccttatttttccccctatttgtacctctccaacagtgagaaacctggatcccattgtcctccctaggtttacctgttcaaccattttctgtgcatgtgaccaatctgtggttgctgtgccctgtcacatggccccatccagggctgtagcaccccatgctgggctgtccccttcctccctgaccatgtgctggaggctgcctttcgcctcaagggctgtgatccctgcaccgggctgtccctgggtgtacacctcctcacttgcatgggctctcacagcctgatctgggcctcactgtggggacacctcctcaccccgtgtgggccctgacagcccgtgccaggccactcccctgcagggacacctcctcacccaagcggagtgggcttgtctgggtcaccatggtctgccatcccctgcacacatgtaccctgctcagccccatgctcctgatggagttgtttaggaggggagtgatgtagtacaaagaatgtttttaaagagaactgcagctactgcaaggagaacagcttgcagcagggctcagctggctgtgggagcctgtgtggaagctgtctcagtgactggggagaggcggcagggcagggcccaggccagggacacacacaacagatggcaagactggcagctgggcttgtagggcacagagagactgggatcaagggaaggctggggtcctggccctgtctccagagctggggaggctgttgaatttgaagtgctattagaaaggccaggcagacatgggtcccagacagtgagaaacttagcactggtgttggagatggcgatttgagagctttctgggaaagtgactagttgtaatagtgagagaggatgagatctcttagggggaagagagaagagaggagagtgggaaggatccacggccgaacagcaggagatggcatttcctaggtagtgggaagccttgggaattttttgagctgtaatgcagttgatctatcgctgttgaacctagagtctagtcagcttgtctgtctgcttgaacatttccagtgactgggagacattattcgttggacacttgtttgggtattttcccttgtattaaaagctagaaatctgtctgttaatttccattccttggtcttaggcagtggagtgctttgtcataatttccgaccaggtgtccttctgctctgccagaaatcacgcctctcgccatctgttctctgcttaatactcttcaacagtcccgtgtgaccacagagtccaggtctaagctcttttgcctccgtccctgtaggcgtccctcaggatctgcacgccccgctttgaggaaagcagtgggattttgctttttgttttggaagccatgttgtgtggtctgtggacctgcttgctttttttgaatgtgagctgctctcaaatctccatcatttgcaccttgcctatttgaaatgttttaaatctaaacagaagacttgtgtattccagggaagctgcgctggttgtgatctggtgagtggaggtcattctgagccttggctgcagtgctgtgaccacgtcggatgtgatatgtctctctcagttcagccaggccatccagagatgtgcttgcgttgctgtccttgtgctggggagcctctttggcctgatcttcacagggacaggggtggggtggggcctgctttggggcccctgggctgggagtgggagctggattagctgtcctgtggggcactgccctgtggggctgccctgtcatgggaaggagtcagaccgttcctggatggtgggggcggcacggttgatctgcgcacagtgttcttggccagctggtgaactttccctgcactgtgcttccctctagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcgacttctgctgattaaccttt

SEQ ID NO: 15123 - DNA, 895 bp, Homo sapiens
taatggagaaaagagaagctttctcattaaggtaaggaacaagacaaggatgtcccctctcaccactttttttcaacattatacaggaagtcctagctaatgttataagacaaagaaaagaaaaggtataaagattgggaaggaagaaataaaaatgtctgtttacagaggacatgataatatacgtagaaaatccaaaagaattgacaacaaaactcctgaaagtttttttagtccttattagtcaattagcaaggttgaaggatacaaggttaatacacaaaagccaatcacttttctatatggcatcaacaaatgaaactagaagttaaaaacacattgccatttacattagcacctaaaagaatgaatacttatatatatatacacatatatatggacctatatacttatagctataaagctaacaaaacatgcaatatctgtgcaaggaaaactacaaaaatccgatgaaagaaataaaaaacaaatgagagataatccacattcatggataggaaggctcaatattgtcaagatgtcagtttttttcccaacttgatctatagattcaacacaatcccaatcaaaatccaaacaagttgttttgtggatgttttagtccatttttgcatcactataaaggaatatctgaggctgggtaatttataaagaaaaaaaggtttaattggctcacagtcctgcaggctgtactggaagcatggtgccggcatctgcctggcttctggtgaggcctcagggagcttttactcatggcagacaatgaagtgggagcaggtacctcacatggcaagagcagaagcaagagagtgagggaggaggtgccacacacttttaaacagccagatctcgtgagagctcactcattattgca

SEQ ID NO: 15124 - DNA, 380 bp, Homo sapiens
agttataatgttgaaaaatgaaatatcaaattgtcaaaaatataaatagaaggaaaaatactgaagacaattaactagctttctaaaaattatttttgaattagtgatttttgagtgagatgggggtctcacttcatcacctaggctggtctcaaaccactgggctcaactgatttttccacctcagcttcccatagttctcggactatagaggtgagcaaccattcctggcggagaaagcatttcttatttctgaacagacatttatgtgctccatggtagtaaatgcatagattttatttatcctcacaacaacaataaaaggagcaagaacagttatggaaaattttagccagaaaatatatctcaaaatcttctag

SEQ ID NO: 15125 - DNA, 227 bp, Homo sapiens
gaagaggcaaaagccccataatagcctacacaatattgaaggagaaaaacaaagaggactcacaccatccaacttcaagacttactgtaaagctacagcaatcaagccagtgtggtgttggtgaaagaaagacaaaccagattaatgaactagattagagagcccagaaatagactcacataaatatagtcaagtgaccttttgtcaaaggagcaaaaataatagaa

SEQ ID NO: 15126 - DNA, 4371 bp, Homo sapiens
gtcgcgtggagctgccgggcgagcaccgttagggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcaggtgagccgcggcggggtgggcggccggggcggccacgccctgccgagggagaagagccggtcgtgtgcggagggacagggtgaagggatcccacttcggggaggatgggcttatcccggcgggcgcgccaggtgggatctctagcgcctcaggggcccgcgcggcaacagccggcaccctcgggcccgcggacaaagggttaacgcgttggcagtgactgcgggccccggatgtgagagccttggcttgacgccctggctgcgctgcaggtgcgccgggccgaacggagccggcagcctggcggcgacctgaccgcccgaggctccccttcacctgcagcggctgctcggctccctctgggaacgccgccttttctaacttaagggcaacaggtggtgccggtggaccgagagagagctcagctccgccgcgctgggagcggcagttaccctcaccaattagggagcgggggcgggagttgcatggcttccctgatgcgggtgaccaatgggatttgggatcatgagtggaccgggaggagtgggcgtggtcggagtctgagtccaaggtttctcgtgcggcaactgccagagctgcttggagagctaagctggaagggtgcttatccctgcgtagaaacgcctgccaatgctttctcatttggacccagactccagatcgggaggtgagaacgttgttattttgcaaggggtaggaggtaatagtgatcttgggtatgctgttaagcatgtggaattagattccgaagataggactatctgctatgagttttctgccagataggcactttgtggttacggccacttagaccagatactggtgactgggttctttccagaatgaggtctttgaggtttggggacccaggagaaaaacgtacatattactgcaatttaagtaaaccagataatttcaatcactgttattccatcgtttgtcttggactgtgtgtgttttcatgtacgtttcatatctcgtctggtttgtttagcgcagcaagttatagtaagttcttcgtgttgtttattttagcaaagtagagcaaacctgttttaatgtattatttcgggagaataacttattccttcttccgtctcccagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtgtctgcctagtgttttgtgcttacatctttcggggggaagcctttgcaagaaaattgcatacaaggctttgtaacgatcaagtgctaatcgatggaaatgttaaggtagattaacatatatgcagttatattgatcacattggtccaaccagtccttttttgaagtaagggacaaggagtaagtattttcttttttaagtttctgccaaatgatttttgacgctttctggaatcaagtaatttaatagtatagcttaattctagacaatgtttaagttggtctacctttattaaaaataagatatttggggtatattcaagtgcatggattagttttcctgacaaagcatgttttggtgtgtagtcttactttttagaaatagctatgcatcgttctacacaggtttaaaacaacttttttggggatttagggctattataggaatagtttgttgtcagaagcactttcacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggaggaaaggcctttatctaattcttatctacagacacttacttccagtgaccatattttactaaatcagcttattttttatgtctaaagcaacagctgttctgaaaaatcaccaaaagaaatgcactttgctagcaggatttgttttggctttgggttttgtttttttgttttttttttttttcagtggcataacagtttttggaaccttgattcttgtgtcacacaaaatgaatgaagtagcttgatgtggagccttcatatgttaaatattcctgcactagtgatggtcacttagaatgtttatagaaatgtggataataactaccaataaactacttgaggcactaggagaacagtatttgactttgaattttaatgtatttccacttttgctgaagcttttaatcagatgtgtaaaaacaattgaccagctaggctatttagtcccatagtagttcagatctgcttagatgtgacaggcattgaaggctgtttttttttttttctcccttcactgatactgaaatcatggtatctgctgcaaacatgagtagatccatgatggattaataaagcttgctgaaaaaaaaaatctgtgtatcaattagatttaccagtttgcctgtactttctgtctacctactatgtaaaatagtgctgtttttaagtatttcaaaagcttgtgtgttgaccctttgtagcctaagtacgtaaacaaattaatgttatctaagtttttcatatttcatggacaacaaaagagaaaatggtatgaacactgtacaaactttgatttataaaagacaatttcagctataaaacccatcctaagattttctagcttgctaagttcaagttccctaccgcctattctagttattaacactgtagtataatgagtctttaaattctgaagagtttagactatgctttcatatctagtttcttcttatggcgcaccttttctagtgcatagttctaaaatattttcttgtatttgaagttacttggtttaatacaaaatattaaggactgctcaactgaatccaagttaatatcaaagaacaaagtgtaagaaaaataaaaccttttgatagttaaagat

SEQ ID NO: 15127 - DNA, 1903 bp, Homo sapiens
tgaagtaagggacaaggagtaagtattttcttttttaagtttctgccaaatgatttttgacgctttctggaatcaagtaatttaatagtatagcttaattctagacaatgtttaagttggtctacctttattaaaaataagatatttggggtatattcaagtgcatggattagttttcctgacaaagcatgttttggtgtgtagtcttactttttagaaatagctatgcatcgttctacacaggtttaaaacaacttttttggggatttagggctattataggaatagtttgttgtcagaagcactttcacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggaggaaaggcctttatctaattcttatctacagacacttacttccagtgaccatattttactaaatcagcttattttttatgtctaaagcaacagctgttctgaaaaatcaccaaaagaaatgcactttgctagcaggatttgttttggctttgggttttgtttttttgttttttttttttttcagtggcataacagtttttggaaccttgattcttgtgtcacacaaaatgaatgaagtagcttgatgtggagccttcatatgttaaatattcctgcactagtgatggtcacttagaatgtttatagaaatgtggataataactaccaataaactacttgaggcactaggagaacagtatttgactttgaattttaatgtatttccacttttgctgaagcttttaatcagatgtgtaaaaacaattgaccagctaggctatttagtcccatagtagttcagatctgcttagatgtgacaggcattgaaggctgtttttttttttttctcccttcactgatactgaaatcatggtatctgctgcaaacatgagtagatccatgatggattaataaagcttgctgaaaaaaaaaatctgtgtatcaattagatttaccagtttgcctgtactttctgtctacctactatgtaaaatagtgctgtttttaagtatttcaaaagcttgtgtgttgaccctttgtagcctaagtacgtaaacaaattaatgttatctaagtttttcatatttcatggacaacaaaagagaaaatggtatgaacactgtacaaactttgatttataaaagacaatttcagctataaaacccatcctaagattttctagcttgctaagttcaagttccctaccgcctattctagttattaacactgtagtataatgagtctttaaattctgaagagtttagactatgctttcatatctagtttcttcttatggcgcaccttttctagtgcatagttctaaaatattttcttgtatttgaagttacttggtttaatacaaaatattaaggactgctcaactgaatccaagttaatatcaaagaacaaagtgtaagaaaaataaaaccttttgatagttaaagat

SEQ ID NO: 15128 - DNA, 310 bp, Homo sapiens
tcagtgttcaaatcctggctctcccgttattacacatgaacctttagcaaattccttgaaacttatgatgagaatgccctcctggttaaatgaagactgtttcatagaattttgagagtgttgaaataacatgtacaaactttcacatattgccaagcatttgataaaaactgacctactattgttaaccagtaggaatcaatatgtttattatttcatctggggcaatttacttgcagccttagtttcttaatttgtaaagtgtgggttatatatatctaccactggggtataactgattaaaaggatt

SEQ ID NO: 15129 - DNA, 209 bp, Homo sapiens
gcgaaaaccaccaccattaacactgaagatgtgaagctcttagccagaaggagtaattcaccgctaaaatacattcagacaaaagtgaagagcttgcgcagattaacctagaacgaaaggcacagaagacaaagaagaggatggaaacaaaaatgcaagggagccagcagaggctggagtacaggaaagttaagaattaaactctcccg

SEQ ID NO: 15130 - DNA, 310 bp, Homo sapiens; identical to SEQ ID NO: 15128

SEQ ID NO: 15131 - DNA, 12638 bp, Homo sapiens
ggggcttctggaggcggcggcggtggccagcgcggcggcgccggccgtattctccgggctgcggagggtaaagagcgggctcgggccgaggctggagggctgggtggggccagagcggcgcttcgggggcccgcggaggacgagggagggagagaatctgaggagctggtaggtttggggacccatctgggtgaccgggccggggaaagggctcggccgggcgtgcgaggggcgtagcggccccagggatgctggagcggagccttagggatgggcaaggccttgggggcggggggaggttctgcaaagggagccactggggtctgcctaggggcttgtgcggagattgcgggcgagaaggggcagaggacggtggaggagactcagatggggccctttttggcggcccgttttggggggtaggggagacggcggttgggggactttgatacatggagcgtggaggaagaggttaatcttgcgaggacagtggaggtcagcgggggagggaggcaaagtgggctttcaggagcgtggaaggcgtcgtccggttcttggaaaattcagaattggagggagtcagagatggttgggggtgggcgggggtgttccatcgatgagggtcttaagagacctgccgagggcaaggaccaggaggggttaaggtagtaacttgggaattttgatcggaatggcagcactttgggaggcctgggacgatcgcttgagccttggagttccaggctgcagtgagccatgattgcaccactgcactccagccagggcgacagagcgagactccttctcaaaaaacaacaacaccaacaacaaaagaagtagacttgagaacttcgttaagacattggccagggagtaaggtagccctgggatttgaggttgaggagaacgtgcaggaatggtgggggattttggctgagcaggttgagagaagtctaggagtgagaggcaaaaaaagacgcaggcagcgtcggggaaatcagaattatgtgtctggagagagttttgcggggtgaaggtggcccagtggggctgttaccaaacttttgagtggttatggggctctaagaggtgacatgacaggacccagcccagtaaacacagcacctctttttgtcgagtttggagcttcagagtggagaggtgggaggcttgtgtttgctggacaggtctgtccattaatctaggagaaaagggtggtgtctcagttcctcacttctgtctttccctgtcttctccagggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcaggtgagctgtctgcccgcacggctgggctccagggataggagagaggcgctgtggggttttctgaacagcagctctcctttcctgttctttatcctgtatgctgagaaggaatgagtcagtatcatgcggtgggggaacgaatttgggccgtggagtcagacagccccggctgtgaattcctgcttgggaatcctctgtgtgtttcctgtggggagaaaagtaattgagccgttacagcagccaagaccgtgcctggcatggggcaccagagcaacagatgccagctgcttttgttattaaaagatgtgtcttctgcctgggcaacatagcaagactccatccctacaaaaaataaaaatgaaaaaaaattaaccaggtgtggtagctcatgcctgtagtcccagctactagggaagctgagacgggaggatggcttgagcccaggagttggaggaggctgcagtgagctatgatcgtgccactgcactgtagcctgggcaacagagtgaaaccccatttatttaaaaaaaaaaaaatctccctgtgttaatcctcttttgtgggaggcactttagtttttttgcccagctcttggatgtttaaagtggggggagggaggggcgtgtctcccagctgggcccaaacctcggtcaattgtttaacatgcttgtgggaaaaagcagaggtttcctcttccagggaggcagctgatttcctgcctgtctgggccttggagggtccccctggggccccaccccctccagactagccaggcaccactaggccctgcctccttttgtagagcctccagccttatttggtgagtttgctactggccagcctccctggagcctccccatgatgtcaccagaagggaatgtaaataagtgagctctgtgtcaggctagggagagtgctgcaggctcttttgggatcctgaggtccctccttcaggaatttcctcgttagtggcagagaaagcatgctccctcctcccccttctcatgcttcagtgttgacccctcctgctaggggtcgtttggcaaaagtcagcaaaattcagccaaatttcttttaactcgccgatttcacctctaggaattaattcattggaaaactgtacatacatggatggaatgacttaagactggggtagttgctagaacgtttaccagaataacagccttttttttttttccttgacactatctcattctgtcgcccaggctggagtgcagtgatgcgatctcgactcattgcagcctcggcctccagcctagcctcccgagtagctgggattacaggagcccgccaccacccctggctaatttttgtatttttagtagagacaggatttcaccatgttggccaggctggtctcgaactactgacctcaggtgattcacctgcctcggcctcccaaagtgctgggatcacaggcgtgagccaccgcaccccgctgggaacagcagcctcttaaatggccttccccaaaccactgcatcagggctggaataggatgcagcttgtaaaaagaaccaggcagggccaggtgcggcggcttccgcctgtaattctagcgctttgggaggccaaggcgggaggatcgcttgagcccaggacttcaagactagcctgggcaacataagttgacccccatctctcaaacaaacagaaattcataattttaaaaaaagtatttagccttctgtttttgccgtgaagccttggaggtctggtgtgtatttcatgtcgcagtttttctcgggactggccacacctcacgggtttgacagctctgggtggccagtgtctgctgttctgacggcactgcttcaggtagtggtctggaacattctcagagatacatgaagtgcaagatgaaggcccagaatgtagcaatttttgtttgtttgtttgagacggtgtctggctctgttgccgagactggagtgcagtggtgccatcttggctcactgcaatcttcgcctcccgggttcaagtgattctcctgcttcagccttccaagtagctggaattacaggcgcccaccaacgtgctcagctaatttttgtatttttagtagagacggggttttgccatgttggccaggctggtcttgaactcctgacctcaaatgatctgcccgcctctgcctcccaaagtgctgggattacaggtgtgagccactgtgcctggccccagcccacactttttttttgagacggagtcttgcagtgtcgcccgggctggagtgcaatgccgcaatctcagctcactgcaacctccgtctcccaggttcaagcgattctccttgcctcagcctcccgagtagctgggattatagatgcctgccagcacgcccggctaatgtttttgtatttttagtagagacgtggctttcactatgttggtcaggctagtcttgaactcctgacatcgtgatctgcacgcttttgcctcccaaagtgctgggattacaggcgtgagccactgtgcccggcttcccagcccgcatttttaaacatcatgaactctatcagtagaaattgtcggtgtgtaggccacgcttgggtcgtgtctgggttgtggcaggcacttaggaagtgggttgggagtgacacctgagaccatcactgaggagggcttgctgtgcccccacctgcgctgggggctggggaagttacagagaagcgaagagggtgggctcagctcttggggagtttctttcccggctggggagatgaggcacgtttcacattccgtagaggaactgagagcctgccagtggccttgcctctaaggagcaagtctgtggccagtgagaccgggggctgtctggaggtgggcggctgtggtctgctgttgctgtaggaggactcagtggcagaacctgaaatctggttggcaatagcaaaacagggaaaggcgtggtttacagaaccaggttgtccaggtgtgcagcggccgcaggtgtgactgggtgctggtgcatatggtgccctgtgtccccggggccgaagtccactccagcatggaggaggcgccctggcagagtgaatgacggggcttatgtgccacccgcagtgcctggtggctcccctctcctggcctggtctgttcttaggcaggcttcttaggtagccttctacgtggtggcccctgccgcgagcctggatccaagcccagcagagggagagagagatcctctcttcccagcaggcgttcagagccctgtggactggaccggtctctttgggctggaaggcgtggttttctgcttgcccaggtccagtcgtgtccccttccacccctttcctgggccactgagtcccacagactgagagtgagcggcaaaggctgccctgggacagctgggtctgttagcaggagacagcgtggagccgggaggtaggcacgcaggaacccggtacccagcagcagctgtctgcttcctgttagagcacctgggctctggagcctgcagcacctggtttgaaggtttgaatcctcccgccactgactgactgcatgaccttgggctagttgctttccttttctcagccttggtttctttaaaatgcggatactggccagatgtagcggctccacctgtactgccaacacttggggtgggggagtgggaggatctcttgaggccaggagttccaaagcagcctgggcaatacggcaagaccctgtctctacaaaaaataaataaatcaggtgtggtagtgtgttcctgtagtcccacctacttgggagggatcacttgagcccaggagttcgagaccagcgtgggcaacatagtgagacctcatccttacaaaaagaaaaaaaaattaattgggtgtggtggtatgtgcctgtagtcccagctgcttgagaggctgaggcaggaggattgcccgagcccaggaggtcaaggctgcagtgagccatgactgaaccactgcattccagcctgagcaacagggccagaccctgtctcaagacaaaacaaaacaaaaacaaaaaaagcggatctggcacttgccttgcactttttatttttttgaggcaggatcttgctacgttgcccaggctggagtacagtggcacaatctcagttcactgcaacctctgcctcccaggttcaagcgattctcctgcctcagcctcccaagtagctgggattacaggcacccgccaccacacccagctaattttttgtatttttggtagagacagggtttcaccatgttggccaggctgctcttgaactcctcagctcaagttatctgccctcctcgaactcccaaagtgctgggattacaggcgtgagccaccgcgcctggccccctcagttccctcttgatatgcattgaactgttcattctttcacttttcaaaaatacgccggtgccatggtgttaacgtgtggctctgcactcccctccacacacctgctgggcatagccctgggaggggtgggaacgccgcgtctgatggtgtggggcgctaaggaattgctctctgagaaggcgcagagtctgcacccccgcagtggccagctcatgtccttcaagtgcctggtgcagggccgcgcccaagaggagcaagtggaggtgacggggagccagccacccccacttactccctccgcctcctccacccccactcactccctccccctcctccagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaaggtgagccctgtagggccctgtggggccggcctggccagtgtgggggtggggatggggcggggaagagcctggaaggcacctcctgcgcgtgggggtgaggtgtggggagcgtgggggtgaggtttggggagcgtgggggtgaggttgggggagcgtgggggtgaggttgcggggagcgtgagggtgaggtttggggagcgtgggggtgagggtgggggaggcccgtgctttccctgctgagcctcctcccaccccagccggaaaacatcatgctgctggacaagaacgtgcccaacccacgaatcaagctcatcgacttcggcatcgcgcacaagatcgaggcggggaacgagttcaagaacatcttcggcaccccggagtttgtgggtgaggccctgcccagtgggcagccccggcctggggagggtggtctggggctgcctgctgtgcgtggggtgggtcatgcccggtgctgggtgccgcgtcctcggccctgaagccacccctcttgggcccggctttgcgggaggtctgggcctccatttggtgcagccccgctgtcctacccgtcaggccctgagggccagctctgccgcattcatgcccccaagggctgcgacatgtgagaaccttgaccccatgcctgtgtcttgagcctcttccttggccagcatgtccccagtgcctgacccacatctccctgttctgcagccccagagattgtgaactatgagccgctgggcctggaggcggacatgtggtgagtgtaccacctgctcccaccgggcctccctgcattcctggagcgcaggccagtgctgcagctggggatgaagcggggccttgctgctgttggggtatggggggaccgttgccctagaacaggggcgctggacgccacggtcctgggagggtgggcggccccacgctgcgctgacccttgcctcttgtctgtccccaggagcatcggtgtcatcacctatatcctgtgagtacctggcgggggccccctcggctgtgcaacacagctggcatgggtccccggctccgtgtgtctcatgtggacgccaggggtccccagcctggctgtgacccatcgcgggtactcaggggataccgggtgaacggatgagtgattctctgtggctgctgtcacagaggcttctggagagttctgaaggcaggacactcacagagcggctgagcaggctccgggttgggggtcgtgtgtgctcctgtccctctggctgctagggagcccagcctcctctcgaagtgcaaggaaggggtccgaccccacgctgggttttggctcctgtccctgggccacacgtgggcctgctgttgtttattatttttatttgttgagacggggtcttactctcttgcccaggctggagtgctgtcctagctcactgcagcctccacctcccagacttaagcaatcctcccacctcagcctcctgagtacctgggactacatgtgcacacaaccatgctcccatgctcggacttttttttttttttgatggagttttgctcttgttgtccaggttggagtgcagtggtgcgatctcagctgctcactgcaacccccacctcccaggttcaagcgattctcctgcctcagtctcctgagtagctgggattacaggcgcccaccaccatgcccagctaatttttgtatttttagaagagacggggtttcaccatgttgatcaaggctggttttgaactcctgacctcaggtgatctgcctgcctcggcttcccaaagtgctgggattacaggcgtgggccgctgcacccagctggctaatttttttttttttttttttttttttgagacagagtttcgctcttgttgcccaggctggatgaagtgccaaggccccgtctcagctcaggcttactgcaacctctgcctcccgggttcaagtgattcccatgcctcagcctcccaagtagctgggattacaggtgcctgccaccatgcctggctaattatttgtatttttagtagagacgatgtttcaccatttcggtcaggctggtcttgaactccagacctcaagtgatccggccgccttggcctcccagaatgctgggatgacaggtgtgagccaccgtgcccagctggctaatttttaaaagtttttgtagaggtggagtttcactgtgttgcccagccatattgaatgggcatagctcattcagtaagcaaggaaataaacaatggcgtgggcccagcccgctgtagtgcgtgagcggacccaaaggcttcaggagatgggctagaccgtttgtattctttttaaatgttcagataattcagacttacaaaggagcaacagaaacagcacagacgccccctgcagcttcctcctccttcagtttacatttttcatgaacacgaacgttatgaacaccaagacgttagccttggtgctacgctaatcacaaaagtgctagatgggccgggtgcgatggctcacgcctgtaatctcagcactttgggaggctgaggagggcagatcacgaggtcagggcattgagaccatcctggctaacacgatgaaaccatgtctctactaaaaatacaaaaattagctgggtgtggcagcgggtgcctgtagtcccagctactcaggaggctgaggcaggagaatggcatgaacccaggagatggagtttgcagtgagccgagatcgcgctactgcactccagcctgggtgacagagcgagactccgtctctaaaaaatttaaaaaatttaaagtgccagaggtggttagacacccccgttttccactcctgtcctctctgaggtccccacacggcatttagccattcagctccttcgccgcctccagtctgaggctgttcctctgtctggctttcatgaccttgaccctgacttgtgctcacgggtcaggtgttttgcagaaggcgtctgagtccacgtttagtctcgtgcgctgtcacgatcagacgatcagacggggcttcagtgtctctgctcaaaaccccagggatgatgctgtgtcaccctcccagcgtcaggctgggaggcagacgctgttggggcctctcactgccgggctgttgaccttgatcctttggctaaggtgttggctcgggctccccactgcagttaccctcccctcggcgttactgagcactgggggctttcgggctctgcgtctgcacagatacttcgagtctccaaggagacttctgcctgttcatttctgctgctgtcagtggcggggtgggggggtggattttgaatgcctcttgggtggtgtctgggatcgttgcaggaaggttctaagggctcaggagtgtgagtggcccaggcacctgccgtcagcctgtcttctgtgctccgcctgtcgtgggcagccggagaggcggcgcggccgtggtgggagcccaggaccccactgagcccccacgcctgtctcgcagcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagtacgaggggccggcagggggcacggggtgggacatgggacacaggcccactccacccacggaggctccagaggactctcctcccagcgccacctccctgcggctggggatcagacattgcttaccccttgggctggagagagtaaactgataaactggtggcccaagctggccattgccatggtttttttttttttttttttttgagacggagtctttttttttgagacggagtcttgctctgtctcccaggctggagtgcagtgcagtggcgtgatctcggctcactgcagcctctgcctcccgggttcaggctattctcctgcgttagcctcccaagtagctgggattatagacgcccgccaccacgcctggctaatttttgtatttttagtagagacagggcttcaccatgttgcccaggcttgtcttgaactcctgacctccttggtttgtgatttgcctgccttggtctcccaaagtgctgggattgcgggcgtgagacaccgtgtctggctgcttgctgtgtttttagcaaacttttaattagttgccggtgtgtaaagtaaggatccatgtaaaattccaggtcacttgttttcctgtaaacacttagaattctggcagtgctgagccctcactcgtaggcctccccgggcctccatggccgcccagtccctctctcgggcgcctgggtttgcgactccagcctgaggtctcagctctctccaccaccccccagaaaaccccacgctccctgcagtacccttgttcagcttctgtggttggctgagcagaggctggggggcgactttagggcttttgggggtcccgggagtcagttgttcacgggaggacgggacagatggtgcaggtgtacctaaccagagcgggggtcttccaggcggagaatgaccattgcccagagcctggaacattcctggattaaggtaagtggggaggtgggggagctccctgggcttcccgccttggccttctcgctggggtcccggggggccttcagcatttaaggcttgtggatgtgacaacccccagtggctggggagggtccccagaggagtgagcctgtgtggcgggggttgggtcctgggcgtgggatgtccagcacccgacagacctggtggcatccttggctggtgtgtgtccaacggggctgactcctggggccagggccgcagcgtttttctcgagagagcactctcggctttgcgtcgggctgggcagtctccgtcacgaggcgttgactctgctgccggatgagcccctgaacctcagttcacactggcaggtgggggctggcggggctgggtggcatcgcggggaccccgctcaggcttccctccttcctaggcgatccggcggcggaacgtgcgtggtgaggacagcggccgcaagcccgagcgcgcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctccacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagatac

SEQ ID NO: 15132 - DNA, 280 bp, Homo sapiens
ttttttttttttttttttgaggtggagttttgctcttgttgcccaggctggagtgcagtggtgtggtcttggctcaccgcaacctccgtctcccatgttcaagcgattcttctgccccaacctcgcgagtagctgggtttacaggcatgtaccaccacaccgggctaattttgtatttttagtagaggcagggtttcaccatgttggtcaggctagtcatgaactcccgacctcaggtgatccgcccgcctcagcctcccaaagtgctgggattacaggc

SEQ ID NO: 15133 - DNA, 278 bp, Homo sapiens
gtggctcatgcctgtaattcctgcactttgggaggccgaggcgggcggatcaggaggtcaggagatcgagaccatcctggctaacacggtgaaaccctgtctctactaataaatacaaaaaattagctgggcgtggtgacgggcgcctgtagtcccagctattcgggaggctgaggcaggagaatggcgtgaacctgggaggtggagcttgcagtgagccgagattgtgccagtgtactccagcctgggtgacagagcgagactccgtctcaaaataa

SEQ ID NO: 15134 - DNA, 2778 bp, Homo sapiens
ataaagaagaaagtaggtgggttacatgaaagcagttatacatcaaaaatatggttttcttcatcttcttttcctccttttcctttctcttcatcgtatctcttcagccacattcacccttaacacaaaaagttcctcctgaaatcctcatgctattttcttggctcaaatccctttgactaccccagattttttggaagaaatccttccaaaggtatttttcatctcaaaaagtttttttgcattcattaccttacttcatgccctcttctttcaaagttccagagagcactgcattcactttgctgcattaagagggaaatagcgtcttctctcctcctatcctgttattgactctcttgtggcttctttcttcatcagagaagcaagtggctcaaccagggcttagaaaaggcacagtgatcaagtctgttcagagccagcctctggctggtgaacatccttgtacttcctgtcctgatctcactcacccctaaggaggcagagagaagggtaaccagtgtggctatcttggctcatcctcgtgggtacaatcaatagctgaggcatgggcttggttgtagagaaacaagtggggccagaggagaggggagaaaggagggaggggagaaagattcccccattggaaattctgctgggattcagtatcctagctattctgatgtcctagatttgaatctgggtttctaaacatatgctctacattatgaaaatgcccaaaaacacatataaattggcttttcttctgtgtttgtcctacattgcagttctataactattttattaagctctctagaactggttcttatatttaccaacactggttattaggttttgaaactcaaaataagaaccatttgtaggcatctgtataaaacaaaatacttattgatcatctactaagcattataccaggctttataacttcctcattcttcttctaagtgttcagtgacttgtggctatttctctaattaaattgaaactcctggtgagaaactttaaggctctccaacaagcaatgtatgttccctcactgtaacttctgtcccagccatacaaactccttctcagttcaccttctctcaagtccaggctttcttcagtgttacttgtgtacctaaaatatgcctatagttcacctcacctccatcctacgtcctatcactgatacaaggggaaatatatatatataatacataaagtcttccttatgatgacttcaaaagaccaagggagggtgtatggttttttttcttacctcaatattcaaatccctgaggttgtcacaaacaatatcaaatcatgattaaataatgatttaattttcttttgtaagttcttaaaattagtatattaatgataatctgcttgaaatcaagccttattgctcttcccatggaattcgaatgatgacaataaattataaacccatcactgtattttcttcattctgtaacatgtcaagtatcagcttaataaattctctgggctacatttgaagtttcttggttaaaaatcagagatccaatgtatcttaaagttaaatttttagatatctaaaaaacatagcatactgcatctgtaaaaatggcatgctgaactttcacaaattattcagaaacaaattttatttagagaaatttaagctaaaaatgcagcaaaccagaaatcagttactgaatgcttcacaatccccagaaaatgagaattatgtaagaaaggaataaaggcaaattttacattgaccctcacagagcaaaattacaggagttctgttctctttgattactaactcagaaataatttatttcaagcttttagcactgaagatgttagttcaaaaaccacatgtttattcttatgcctgtgttgataaaactttgctaaatattttatatgtattaaaaatggagaatgaaagagatgtgtttcaagagccttttacagataaatcctaacaatcaaataggaaatagaacattaatgtgaataaaatgctctggcaaggtaggaagaaatgaataactggaagtagagagtccttagcattacaaagtggtaagatttctaaaacagtcatcttgtgagttttttatgcactgttaatagtaacaatacgttccatgaattatgcagttgggatgatttctccttgtgtggattgccagttctagaaatcagtaaaagtgaagaatgagttgaaaaacctatcagcctactgaatctactaaagcctctaaaatattcaatgtctaattgcagcaatttgtatttcataggtgccatatcaaaatcttctccattgaggtcatgattgagtctttaaaaaaaaatttccagatgtgaagatatatatatatacattttaagtttccagcattgtgtgtacaagaaaccaaaacctccatggagggcatgctgatgagttgcatggcacaattgtcatttctgttttgattgcatgtcctatttttgaacctgtaaaagtgtgtagtgcatatatgtgtgtcctatatatggcaatttgtctgatagtgtgtttgagttctttctggctctttttctagcagagttcaatccacagctttcttcattggagaatttgtgaaataaaagtgagttaatttgtgttacacactctcttaaataacctagacctacaaattgcttgcctaaggctaaaaaatagaaaattcaaagaaacatatgaatgatctcagttggcctttgatgagtaaaaaaaaaaaaaaaaaa

SEQ ID NO: 15135 - DNA, 2781 bp, Homo sapiens
ataaagaagaaagtaggtgggttacatgaaagcagttatacatcaaaaatatggttttcttcatcttcttttcctccttttcctttctcttcatcgtatctcttcagccacattcacccttaacacaaaaagttcctcctgaaatcctcatgctattttcttggctcaaatccctttgactaccccagattttttggaagaaatccttccaaaggtatttttcatctcaaaaagtttttttgcattcattaccttacttcatgccctcttctttcaaagttccagagagcactgcattcactttgctgcattaagagggaaatagcgtcttctctcctcctatcctgttattgactctcttgtggcttctttcttcatcagagaagcaagtggctcaaccagggcttagaaaaggcacagtgatcaagtctgttcagagccagcctctggctggtgaacatccttgtacttcctgtcctgatctcactcacccctaaggaggcagagagaagggtaaccagtgtggctatcttggctcatcctcgtgggtacaatcaatagctgaggcatgggcttggttgtagagaaacaagtggggccagaggagaggggagaaaggagggaggggagaaagattcccccattggaaattctgctgggattcagtatcctagctattctgatgtcctagatttgaatctgggtttctaaacatatgctctacattatgaaaatgcccaaaaacacatataaattggcttttcttctgtgtttgtcctacattgcagttctataactattttattaagctctctagaactggttcttatatttaccaacactggttattaggttttgaaactcaaaataagaaccatttgtaggcatctgtataaaacaaaatacttattgatcatctactaagcattataccaggctttataacttcctcattcttcttctaagtgttcagtgacttgtggctatttctctaattaaattgaaactcctggtgagaaactttaaggctctccaacaagcaatgtatgttccctcactgtaacttctgtcccagccatacaaactccttctcagttcaccttctctcaagtccaggctttcttcagtgttacttgtgtacctaaaatatgcctatagttcacctcacctccatcctacgtcctatcactgatacaaggggaaatatatatatataatacataaagtcttccttatgatgacttcaaaagaccaagggagggtgtatggttttttttcttacctcaatattcaaatccctgaggttgtcacaaacaatatcaaatcatgattaaataatgatttaattttcttttgtaagttcttaaaattagtatattaatgataatctgcttgaaatcaagccttattgctcttcccatggaattcgaatgatgacaataaattataaacccatcactgtattttcttcattctgtaacatgtcaagtatcagcttaataaattctctgggctacatttgaagtttcttggttaaaaatcagagatccaatgtatcttaaagttaaatttttagatatctaaaaaacatagcatactgcatctgtaaaaatggcatgctgaactttcacaaattattcagaaacaaattttatttagagaaatttaagctaaaaatgcagcaaaccagaaatcagttactgaatgcttcacaatccccagaaaatgagaattatgtaagaaaggaataaaggcaaattttacattgaccctcacagagcaaaattacaggagttctgttctctttgattactaactcagaaataatttatttcaagcttttagcactgaagatgttagttcaaaaaccacatgtttattcttatgcctgtgttgataaaactttgctaaatattttatatgtattaaaaatggagaatgaaagagatgtgtttcaagagccttttacagataaattctaacaatcaaataggaaatagaacattaatgtgaataaaatgctctggcaaggtaggaagaaatgaataactggaagtagagagtccttagcattacaaagtggtaagatttctaaaacagtcatcttgtgagttttttatgcactgttaatagtaacaatacgttccatgaattatgcagttgggatgatttctccttgtgtggattgccagttctagaaatcagtaaaagtgaagaatgagttgaaaaacctatcagcctactgaatctactaaagcctctaaaatattcaatgtctaattgcagcaatttgtatttcataggtgccatatcaaaatcttctccattgaggtcatgattgagtctttaaaaaaaaatttccagatgtgaagatatatatatatacattttaagtttccagcattgtgtgtacaagaaaccaaaacctccatggagggcatgctgatgagttgcatggcacaattgtcatttctgttttgattgcatgtcctatttttgaacctgtaaaagtgtgtagtgcatatatgtgtgtcctatatatggcaatttgtctgatagtgtgtttgagttctttctggctctttttctagcagagttcaatccacagctttcttcattggagaatttgtgaaataaaagtgagttaatttgtgttacacactctcttaaataacctagacctacaaattgcttgcctaaggctaaaaaatagaaaattcaaagaaacatatgaatgatctcagttggcctttgatgagtaaaaaaaaaaaaaaaaaaact

SEQ ID NO: 15136 - DNA, 1887 bp, Homo sapiens
ttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcacctcctgtccatgtctatctgtctgtctgtcggtctctgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccacccgtgctgctcaggtgcaaatggacttgagaacatctatgtgctggtgaagcatgaggtctgagtagaaaaggggtatcccttgagaccaccttgggaccagtgcttgcaagcagcgagatatttccccagcaaaaccaggcagctgctaattaaatgcttagaaccaatgaaagctggctgtggtcctgcctgtgagctgcctactgctgccttctgaatgcatatatctgctactgtagccccgggttgtcaaactatggcctgtgggccaaatccagccacagtcggttctttaaagttttatcgaaacacaagcaatggaaatgcccatttccattgttgtctccagttgctctgctccgagggcagtgttaagttgtgcagcagaggcccctccatgcaaagctgaatatgtttactatttgaactttttcagaagttctgcttaaggacaaaataaagcctaaatccaagaacacttttaaaaatgaggaaatagtgaacacaatagacggaagtctggaagtttctacccatgccaagaaaagcattttatgttttgttcacatatgttgtgcaattcaaatttttttccctatattctctgactagacacttgtactgagtcaattggcgagtgtgtctgtctaaaaccacaatatcaaaatatcacttaaagcatctttacatagtgtgtttaagaaaaagttgttattcagcagaaaggtaattccaattggtctgcatatttatcagcacttggtattgtctgtttcttattttagccattctgataggtgtgtactgatatctaatcatggctttaatttgaatttccctaatggctgatggtgaacatcttttcctgtgcatttctgtcatctgtatgtctttggtgaagagtcttcaaatcttttgttcatcttaaaattggattgttatattaccgttgggtttaagaatctacatattatggatacaaatatgttgtcagatatgtgctttgcagcattttctcccagtctgtagcttgtctttaaaaaaatttttttt

SEQ ID NO: 15137 - DNA, 1546 bp, Homo sapiens
ggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccacccgtgctgctcaggtgcaaatggacttgagagcatctatgtgctggtgaagcatgaggtctgagtagaaaaggggtatcccttgagaccaccttgggaccagtgcttgcaagcagcgagatatttccccagcaaaaccaggcagctgctaattaaatgcttagaaccaatgaaagctggctgtggtcctgcctgtgagctgcctactgctgccttctgaatgcatatatctgctactgtagccccgggttgtcaaactatggcctgtgggccaaatccagccacagtcggttctttaaagttttatcgaaacacaagcaatggaaatgcccatttccattgttgtctccagttgctctgctccgagggcagtgttaagttgtgcagcagaggcccctccatgcaaagctgaatatgtttactatttgaactttttcagaagttctgcttaaggacaaaataaagcctaaatccaagaacacttttaaaaatgaggaaatagtgaacacaatagacggaagtctggaagtttctacccatgccaagaaaagcattttatgttttgttcacatatgttgtgcaattcaaatttttttccctatattctctgactagacacttgtactgagtcaattggcgagtgtgtctgtctaaaagcacaatatcaaaatatcacttaaagcatctttacatagtgtgtttaagaaaaagttgttattcagcagaaaggtaattccaattggtctgcatatttatcagcacttggtattgtctgtttcttattttagccattctgataggtgtgtactgatatctaatcatggctttaatttgaatttccctaatggctgatggtgaacatcttttcatgtgcatttctgtcatctgtatgtctttggtgaagagtcttcaaatcttttgttcatcttaaaattggattgttatattaccattgggtttaagaatctacatattatggatacaaatatgttgtcagatatgtgttttgcagcattttctcccagtctgtagcttgtctttaaaaaaaaaattttttttttttattt

SEQ ID NO: 15138 - DNA, 1733 bp, Homo sapiens
ttttttagagatgggatcttgctacgttggccaggctggtctcgaactcctggcctgaagtgatccttctgccttggcctcccaaaatgctgagattgtaggcatgagccgccatgcctagcccagcttgtctttttgtttacttaccagtgtttttcagagaacaaaaattttaatttgatgaagtccaattaattaaatttttaaaatagagtgtgatttttttgtcatgtctaagaaactattgtctagtcctaggtcctaattctcctttgttttcttctaaatgttttattattttacatgttaacgtttagatttatgatctattttgagttaagttttttttaagtatgaggtttatgttttttgtttgtgtttaggagcatatggatggatgtctagttgttccagcaccatttgttggaaagactatcctttctctgctgaatttcttttatatctttgtcaggaattagccatattggtatgggtctatttctagactttttattttctcccattgatctgtacatctctccttttgccaataccacataagtcaagatgactatagctttgtaataagtattaaaatctggtaatataattcttccaattttatttttcttttaaaattattttgactattgtatcagtgttacctttccatttaaattttaggattagcttagctacaaaagtcctgctgggattttgattagaattgcattaaatctatagataagtttggggagaattaacatatttatgatcgccttttaatccatgaacatgacgtgtctctccatttatttgcatgtttagtttctttcttcagcattttatagttttagcatacagatcttgtacatattttcttagatttataactatttattttcttggagctgttgtaaatggtattgtttttctgatttttggtttctacttgttcattgctggtgtatagaaatacagttggcttttgtgtcggctttgtatcccgtgatgcaagtaaagcagtactgaggggaatttatagggctcaatgcctgtgttagaaaaaaaggtctcaaatcagtgacctcagcttccactttaagaaactagaaaaaaaagaccaaattaaaagtgtacacagaaaaggggaaatcatgcaagtaaaacagaaattagacattaggaagagaaaatatagaaaattaattaaccaaaagctggttctttgagaagctcaagaaaattctctttagactgatcaggagaaaagatagattaccaatgtcagaaattaggtagcttcactacagattctacagatattacaacaataataagagactattacgaataacttctaggcatacatttgacaatttagatgaacccatgcagattccttaaaagatacaaattagtttacttaggaaaaagtggaaaacctacatagctctatgaaagatgtgttatcacaaagaaaacggtagacataggtagctttagtggtaaatgttgccacgtatttaaggaaataatactaattctgcacaacctctcacaagaaatataagaggaaagaatactcagttctgtctctgaggccagcattgctttgatccccaaatcagacattgcaagaaaagaagacaattatccctcatgaacatcaacacaagaattcttagagttttatcaagtccaacaagttaaataaaaaggattacactttt

SEQ ID NO: 15139 - DNA, 15727 bp, Homo sapiens
atgctcacctgttacaccagttttaggataaagaaactggaagaattcctcagggatcagtccataacgaacttttcctccgtattcaggaagaggtggtacagggacaaggtgtggctgccctgtatgaaaggtccttgttgcctgcaataccctacaggtagtaattgtacaaatgtaaagcctgtttctttaaggagaatacagtgtatgaataatgagcagaaacaataaatagggttgataattgaggcagttttctaactctcataatggaaagagaatggactgggaatggaaggttagggtccagtaatcagctgtgacaacagcaaagaattaatcacagacatttaaccttctacccaatactggaatcccttctatcagccttgcagatcatctgtctagcactttgtatgtctatcattagcactgaaatatgtaagaatgtggacgtggcggtcagataggcatcttgagttcaaatcctagacctgctccttgactttgagtaaagaacttaagcttttgtaatctcagatttctctcagtaaaatggaaatagaagataataccttatatggttgttgagaggattaattgagttaatatatgtgacgtgcttagaatgatgcctggcacatggaaaagttctacgtaagtggttagctattatatgcctgatatgttgtaagctcctggacctttttgaatactctctttgatgagagtgctaaacactatatgtaacagactttttcagtactgggtagctctaattatgttcatctttgaattgagatgatacatacattcttggaacctcaatccattcttagttctaattttgcttttctatgtaagataacacacatgtacctgggtcaaacatctgttccctcacaatcctgattgcccgtaaggacttctctggttttatcttttttttttttttttaatgaggtatacagaactgaatataatactttaagtatagtctggccaatttattcatcctacaaatacttattgagaacttactattgccagtactgagcttgaacaattgaactattatcaacagtggatttggaaactattcttgtattaaagcagcttaagactacacttttaacagttacagcatactgatgtctccttaagcttctgatgaaataaaatctagtccctttatatctgctgtcatttagtctccttcaagttttcagtgtatttctgtcccacttcctaccctccattcctccaatctctcaacttctatctccttgtaatataagaatttacattatttcatttattttggtacaatgcttatcttttgaatattatttctgcctccaaatatattagctaccccaccaggttttgaaatctgagaatcatgcttgagatttcttcatttacatcaaggtttctcaattcagcactaccgacgtttgaactggatatttctttgttgtaagaggttgttctgtgcattgtagaatgtctggcagtatctttgtggcctttatacaataggtaccagtagcccctccctccccgacccatcctatggtaacactgaaaaatatctccagacattgctaaatgtcacctgcaggcaaaccaccccaggctaagaagcactgatttaaatcatagcactaaatggtatgcttaggctgacaagtctccctaactagctaccttagttcaagtccttatcacctcttgcttagtttaacaatacaaaacctggtctctctgcttattttatttatttttttgagacagaatcttgccctatcacccaggcgggagcacagtggcatgatctcagctcactgcaacctccacctcccaggctcaagtgattcttgtgcctcagtctcccgagtagctgagtagctgggattacaggcgtgtgccaccacacccagctatttttttttttatttttaggagagacggggttttgccatgttggccaggctggtctcaaactactgtgatctgccgtctcggcctcccaaagtgctgaaattacaggcgtgagacactatacctggcctctgcttcttattaaataccccaacttaaacctagcccactcacattactgccaatgtttctaaaatgaaaatctgacttgaaaactcaacaggctctctcctgcctacagaaaactacttaatataacatacataatctagtacctgtcatttttttttttttttgagacaaagtctcactgtgtcacccaggctggagtgcagtggtgccatcactgctcactcgcagcctccacctcctgggctcaagccatcctcccacctcagccttcccaatagctgggagtacaggtgtacaccacaatgcccagctaatttaaaaaatttttaaaaatttttgttgttttgtttttgtctatgttgcccaggctagtcttgaactcctgggctccagtgatcctcctgccttggcctcgggattataggcatgaaccaccactgtgcctggtcctgccaaattttataaccttatcttccttcattctcttactctcctggaattacttaacagctctcaaaaacaaacaaagaaacaccacaaaaaaattgccttatgctgctccttctgccttgtatgcccttcataccatgactttatagcaatgactatcaagaccaatcaggagcaatgactaccaagaccaattagcctccagatttgtaaagccctccccccattttgggctaacattcattcttttaatcaattaaaaaaaacatttactgactttctactaatgctaggcaccggtaacatggcaatgaacaaagctccagccttcaacattctagtgggggtatgggaagggtgagtgtgtatctccatacaaaatttcaggcagctctaagtgctatggagaaaaactgagcaaggtaagcggatagggagcaacaaaatggggaagagttttttggtagggagtcagatgacatttgacccaatcatctggggaaaagagagaagagcaagtagaaagatattgaggcaagaatgcgcttggtagttttcagaggaacaccaaggttggagaatgagctaaaaagagaccacaaggagatggtgtcaagagataggatggaatcaattcatgttggaccttctgggttatgctaagtttggattttattcaagtgggatggggagctctggaaggccttggtgggggattgacataatcctcctggctattatgagaatgggctgtaatgggacaagaatagagatgcaagactaattaagagactactaaaatacctaggtgaaagtttatagtggttcctactttagcggtagtggaagcagcagtcagagtccaaatttctagaggaagagccttgctgaggtactggacatggagtgtgaaagaaaaccaaggatattccttgtatcttgtaagtataagttatttactacctggtattacaattatttgtttaccagtctgtatggggtcctttttcttctaagttggaagcagtcaattatagccttactttttgcatacatgagacttaattatagataagaccactttttcaagtccattttttttcaatttgagttaccgtattttgcaagctttagaactaagtttggaagtaaaaagagaaatctctaggaaaatggacatgtcttatggaacaattttaacggtaacagctgctaaatttactaagcacacactatgtaccaagaactgtttttgagtttcacagcaattgtctcttaattctcaaaagccacaatgcactattatcgccattttatagatgaggaaattgaggtcacacagccagtaagtggaggggccagggaccctgtactggctgtggagccctcactctaaaccaatactcttaaggtgcctcccattcctagactgtgagctccatgagggcaggtaattagccatactcattcttgtatccttggttatgtttttaggcaacataaatatttactgaatcaatgaatgatttctctgattgttatcatatggcagcaaaaactaggtatctgggaaaccgactgtaaacaacatgctttactgttttattgaacaaaatttattcttgggtatgtaatctactcggattcaggctgtggaagctacatgtcataaggtcccaagggaaggtcacaaaggagtagggcgggtatagaagacagcaaaaccaatttctagtttagttagaatacgttacttatcctgctaaaatcttggtcattaggtgacatgagagcgttcctggcagttacaggaacaagtgtcttgtctgaaagagggtttaagtgtcccaaaattatcggaaagaaatttctgacctaaagctaagggggtgggggcaggaatcgggaaataaaaggtagtgaaaacaaagacgaaagggagcattatcctcacacttaccctggacctaggaaggctgcattcttcagagagggggctgcagatagacaaggcgaaggtcagcaaagtcaaatgaaatctggtttgccctttccttacccccgccaggctctatcactaagcctatgtacccctctttcccgtccctcaagaccccacgctcccttccgaactgcactgaccactcgcctctcaggcccgtgtcgctgcgcccttctcccctccctgtcacccctagattcgcttctttccaatcactctgatagtccagagcagggtctataccccttacccgctgtggcggcggcggaaagtaccacccgggacagcatggtcaacgaaagtccaggtagcaatcttagcgtccctgtgaccccgataggagaatctgtcagggcagaaccaagatggccgctcacaagtctcgcgagatgaaaattttgtactcttccttcaactttccttgggagatttttaaaaaaaattatcgcgagaagagtcaagtaacgctgagagcctatcgcatgagggcgacagccggaaagcaggatggagccatagaagcaattctcgcgagaagtagagttgcggttccctcgggagaggggcggaggctcagaggtgcaccacgtggggtttgctgccggagctgagtctccggccggcgtccagtttgagtctaggttggagttggaaccgtggagatgcgaaaggaaaacccaccccccctagtgcccccggcggcccgggagtggaatcttcccccaaatgcgcccgcctgcatggaacggcagttggaggctgcgcggtaccggtccggtgagccgagatccgaggcgtgggagctcccttaccccgcccagggcgcccctccccgcagactgaccctatcagcacatccccgccctgcatgttatcctgacccttggttgtgtcaccgagctgtcctcagccctgcacggcgttcttgagctcagatccagaccccgaaggacacgctgttctgtgcggtttccatgtaggtgagcccttctacccttcgcgaggtgccagcttgtagcccccgtaaatgaggcgcttctccttagggcctccagcttgagtgggtgaggctgggccggctccctccggctttttatgtacccctgtaccgcccccaactaaggcttctgctccgcggtagtccaaacggaggctggagtgactgacctcacttgggttggggagagaggtattctagtggcctccgattcaggtgagtctctatcccattatccacccccacccccgggtggaacggtagaatggagacttggggtaccgtagggttgagctcaatatctaacgtcctatactcagtgctggaggagcctgagagtgttggccccgaatgcaaactcttgtgtaggtgggaaataccttttctaaaattctaaattgtctggtgagatttcctagaaaaatccgtaacaaaattaagcaacggattggaaccatttttcttctgtgtaacctgccccttaacccccacagcccagaccaagcataatcttgattttaagatgacattgaagccaatctgtgctacatgtctcttcccatttcttaccgctttcttgtcttcattctgctttctttttgttgactgttaggcttagcgatgcaggctttggcattttttttttttttaaatcagaatttggaagttggccggcattgcatggaagtttaaagtcccagtttttgatagatttaacctctctgacagttgagcttgaacactacataatcaagacaacttttggcggattctctatacttaaccagtcactgtgcaagacgttcaattattcaacatatttttaaagactctgcaagacatttattcaactagttcagcaaatacttactagtgtccaaatattggggaagtgttaacatcactggatagtgtgctgcttaaacagttgtggaaacttcatccttgtccccttgcagctcattttccatattctctcactaaaagcagataatgaattttacagactgttccatctttgtctttttctggaagctttctgcacctacttgtctgggctgtcattaggaaaacagtaacgcagaataaagtcaaagactcagaaattagctgaactctccaatgatgtggactttgcttttacaggaataactaacttactttgttaatttagtgacaatggctctttgaatcctagaagtgaattactgccttggtataatccaagctcatgttttccttaccctacccccaacaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctggtgggtccctgttctcattgctcctgtctctaagcctcctgtgggtgcctttcctatcctgttaacctcattaggtaacattttgggcttattctaagaatccagtgacttattttagcatgtctataaggtttccttagggattttgcagtccatcgtaagtagaccatagcagcagtccaagaggcaaagacttggggaatgttgattacaggaagttcttgtttgaacacgtttttatgttgatagtgtaggtcaagattaaatgtctgtttgcttttgcttcttagcatcaaggtttgggaccttgctcagcaggtggtactgagttcataccgaggtgagtattctttcatttttagccctggtgttagctgttgtgtttttggactttttgaactttgctttgatgttaggagcagcaattccatgttctgatagttttcttgtaaaacaatagtcaggctccggtatctactccttgtccttttctcaatttccttgtttctttctttctttttttttaattcgactagtcaagtgcagtagtgaaaagggaggaaagaatagaacaaggagtttaatctgtaactgactgaacaatcaactgagataactcactaccttcagaccagccagtttccctgtttctattgatggcctcaccaccttggcaacacagggctcaaactcggtccttttccacctcttctgttttcccaccatcggttggccactaagttctttttagtcttttccactggtcagtcaccttcctgtccatttctatgcccgtattcactttcaggctttaccttacacaggcagtggcactcatctctccactagcaatctagctcttttggtcttttattagtttcttgtggcctgtggattaaaatcccattttcttgtcatggcattgaagcccttttactccatttcctctcttcaagcttactagatccttgacattcttgagggataaatcttgagacttttaaatcttgaacttttgagtatttaccttcataaaatgtctgttttctggtgagaaccattacttttttaatgcccctctttctgctcactttcattaacagcactagtagttaactttatcttgggagccattctttgtgaagataatgtctagagccttaatgtgtacatggttccaaggtttagatgctgggggatcactgtggttctctcaatggctaagtgcctttccctgccatttctaacttcaaagtacatgactaagttataggccagagaaatcactgactcatatccaaggtccagtatcctggaccctcagggtcacttggaaatagttttacaataatgttgaatgcccagctgtgcgcagtggcttaacgcctgtaatcccagcactttgggaggctgaggcgggtggatcatatgaagtctaggagtcagagactagtctggccaacatgccgaaaccttgactctaccaaaaagtacaaaaattagccaggcgtagtggtgcacatctgtaatcccagctacttgggaggctgaggcccgagaagtgcttgaaccctggaggcggaggttgcagtgagtcgagatcacgccactgcactccagcctgggcaacagagtgaaactgtctcagggaaaaaaaaaaagtcaatgttctatgtctattatatttgctttttatttcttagacatatgatgtgctttcctggttaatgctaactctttttcagcatttctgccatgcagcctttttgttagttctttgtgtttgtgtcttattccccctgctgaattccaaatcctttattatttttctattttttgtagagacagagtcttgctatgttgcccaggctggtctcaaattcctgggctcaagtggtctcctgccttggcctcccaaagtgctgagagatacaggcatgagccactgcaccctgccccaaaacctttgagggtagaggaaccatgtattcatcttttgtacaccaccatggtgcttgtcccagagctttgcttttttcaagtgagcaataaattccttttcttacttcttatcctgttggctttctatgaattctagggctaggaaagaactatggaaactggtttaattccatccttctgcctcagggaagggccacattcagactacctgggaaagtctggtaaaatgactgtagaaaaggtttccacagcttctaattaacatgtagcagtgactttaaagttttttacatgtagacctcctaaaacagttttgaaaatctgtgccccctcatacatttttaaactgatacctaaaaatgcttatttaagtagttgcagagaaggtaatttctggcatataatttattgtgtgcttatttcaagcatatatttgtcaaaattttagattcgcaggttaacgctacttagtttgcatgaatgtctaccaaacagcctaactggcaaaagccagtctgcattgtaaagccagtggaccaagatagactaaattttctgtcagaaaaagtctgactttgtttttaaattcagataaagttgttgaatatgtccttatcacaatgatctatcatattttttagttctcattattagacagaaacagagttaagtcacagagccatacttgtgtttgtggtgtgactgaaacaagatcagcccccttcattgaattttacctagatgctctttctttttgctctttggttcttatggaaaagccccttttgtcccttagtttagaacccttatatttttatacccctgagcattgtagcgtggaaagatctgggatgaatgacaggtatgtgttctttctatgaagtgggagaagagtgattgaaaacagaggcagttcaattttaagaaagagaacattagagaaattggctctcttaatactattagcgcccagaactccctcaaaagtttttgtatactacttggaggtgtgtgtactccagtatgaagactgctattctagaattatttagccctcacatctaggatgcctaaactggaaattcctttgttattcttactaagcccctaatttctcattcattatcttcactaatacgttttttttttacaaggctttttaggttttataagtctataaacttctcctcttagcttttgtctaatccataatctcccacaaaatttgttaaattgcatcatgagaccagccctccctccctcctgccccttgattattcctgggctggccctctagtaatgcttcagcttgttttctatcatatttctctttctctctcctttatagctcatgctgctcaggtcacttgtgttgctgcctctcctcacaaggactctgtgtttctttcatgcagcgaggtaagagatagctccttcttccctaaacacactccagccatccataggccaaagtctctagtggggagactttctggcctgcaactgctcctttggattatgaaatcctttttctgttccaccttcctctaggacaatagaattttactctgggatacccgctgtcccaagccagcatcacagattggtgagtctgagattcattggtgggagaatagtacttggaaccctgatagaagagactgtctttggccagtgtcaaagcatagttgctagatgcccagtgtagttactgtgacatgagtgacataatctccttcttttccagtgaggctctgctaaccccattctgtgcaatgaataccaagaggaagggccagttcctgggtgggtgatttactttattagatggtaggacaaaggggccagaattgttatcgtcatgattcgtgcctgaaacttgcctgtgactcgtgtccagaaagggcaggaggctgctgggataaatggttatgaggctcaaggatgaggacactgctgccttagcagggtttgggaaatcaaataaaggtgctcccaggatttagagtgatatcatttgagaaactgcttcttctgtactctgagttttggtccagaccctcgtctctcctttgcaggctgcagtgcgcctggctaccttcctacctcgctggcttggcatcctcagcaaagtgaagtctttgtctttggtaaggcagcgtgtcagacttcatattgactctgggaaaggggaggaggaaaaagaaagagctgactccacaacacacaaggcccttgttgctcagtcttagccctcatggacactagatgaattatgaattgagggtggggaggtggggtgatgccaacgtagttttagtgtagttttggagaacatgattattttcccagtggatttgatttttgattgattgatccagcttctgtattctgggcatggctataagtcagtgatccacaaagcaagtggattgctatatagcgaattctgtccctactgtgggtaggtgtagcgctatcgtggtcatgaggctgtgtatatggtgacatagtttgtggttaaaataataactgcttcgttcattaacttaattttcacaatgatccagtgacttattattcctactttgcaaaagagaaaactgatgctcagaatggttaacttttacaagctcgaggaactaggattcaagtctttggcacaaaagtccatgctcttaatcactatgacatgttccttctcttctacaggtgatgagaatgggacagtctcccttgtggacaccaagagtacaagctgtgtcctgagctcagctgtacactcccagtgtgtcactgggctggtgttctccccacacaggtactgttctttgtcatcaggggcctgatgggtataaatgggaacagtgagggtgtgtgtgtatgttttcaaagcattagctgatgaagtagttccttaaagcagacagtgttctagctgaggtttcggaacatcgaagatctcttaagtgtgaagtagaatcctttgggagtcaaaggatttttcagattagatggtttctgtctgaaatggctaaaatgtgatttcattcctgcccaacacccaaaatggttaatgttgtgggcttctaggactgtgagattggaaaagcctgtgtttctgggttattgctgaagctatagagagggaccagatggggtggttagttgccaggatggttgtcaaccctaactttgcttcatttccctcatctttacttgaaacttttagtgtggacttgtagtagccagattagccaaaagtgggaatcaggctgcctctcctgggtcactttacagtggcggcagggccggcccagttaaggttttgtcttgggatccaggctggacctttcacaaccctctcctccatctgatagtgttcccttcctggcctctctcagtgaagactgctcacttgctgtgctggactcaagcctttctgagttgtaagtgtgaagtggaatcctttgggaatcagggaaggggagcagtgggtgggcgagtcattttcctcttcagaaaactgtgttgtgcttttggagaacagattctccatctgtatccgaagggacttggtaatggaagcaggctggctgttgaccctgtccattcctggggcacattcacaaccccaaggacaagccgtgtccttggtagaggggggtggtaggtgaaatttttaagtctagccctccagcgctctcccacaagggggcggcagtctaccctctcacataaagaactgcgtatgaaatgcagcctgctacagggtaaaaggcagcacctggaagacctgaattgtacttccctccttgccgtgatttgctgcctgttactgcccctcatcactgtcttgttctatccagcatttcttcatctatgaaaatagaagactggattggatgactggtgacatccactgtggatagctacactgctatcctggcgatgaggccatacagttggtgaaatgtgtgtaacacacccaaaaaatgtgccccagatgtgttgggttctctttttttctccaggtctgcttttcttgtctctactctgccccgactttttttctttcttctaggtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccacaggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgaagcatgtgtgttatgtgtagttagatatatttcacttatgtgagtcatcatggtgttggtcttgtagcccattatttttcctgtgcttccccagcttcccaaagtagctagttagaacttaaggtaaatatttattcttgggttggtggagtggatattgccagttaggagtcatggatcaattactgattatattgaaagtaaatataatcaattatgtacttttgagctttgcaggttcaatttaggtaaaaatcacattatgaaactgggaaagtctgaaggaatatgggcaaaatatttctcagtaaagcttccatgcttcacccttgacatgattacccttgagtaaaacatgggaatttgtagttgtgtgatcctctggcgttgatgtggagtaggaataaagtcttgcatcatttttataatgtgggaggaaatagaatgggtaggtacaatcacttaagttctgcctctcgaagataaaactttaattttgtggacacttagagaaagtaaggggtgggggagcttgaggtgagtaggaatttgcatagcccttttcttcctggacttaagaatgatagagaaaaaactcagtgaaagagataaggaagcaaatgtgtggaaatgtgtgataaggaaggaaatgtgtcaaggtggttacaatatggaagggaagcataggttttttttttcttttgttgagatggagtttcactcttgctgcccaggctagtgtgcagtggcatgatcttggctcactgcaaccttcgcctcctgggttcaagcaattctcctgtctcagcctcttgagtagctgggattacaggctaatttttgtgtgtttagtagagacagggtttcaccctgttagccaggctggtctcgaactcctgacctcaggtgatctgcccgccttggcctcccagagtgctgagattacaggcatgagccaccgtgcccgaccagaaagcatggtttttgaaggaccatattttattgtaaaaaaatgttttggttcagatagatgtgtgctgatgggagtaattcacatctatcagtgaccaccaccaagatatttataaaccttatcaaatacagtaggaagagcaaccagcacaattttggataaatgtatatgttgcagtgaacaaagaagatagtttaaaataaaagatgaccacagaataattagaaatggtactgtcacatatggagtgatttgctaggtccttcacttgaggatagttctagtagagtgagtgcagagctgatgacaagttgaaatgagatcaatctatttgtttaaaaatatacaaatattttgcatttaatttcatcggttaaaatgtctaaacattagagtaaacccatttccctatctacatccttactctgaagtccactaatcaaacctactcttccacagctgttctctggtccaccaagggctatgaggctcaccccttggatggtgctcagaaccacaaggaatactgaagaagccttgcctatgatttcaggtggcatcagacattgggctaattttcaaggtgtctctccttcccaacaggacagtcggagtctggttctttcataaatagctatatggatctta

SEQ ID NO: 15140 - DNA, 23936 bp, Homo sapiens
tttttttttttttttttctagatggagtcgaggtctgttgcccaggctggagtgcagtggcgtgatctcagctcactgcaacctttgcctcctgcgttcaagcaattctcctgcctcagcctcctgagtagctgggattacaggcgcctgccaccatgcccggctaaccttttgtatttttagtagagacagggtttcactgtgttggcctggctggtttcaaactcctgacctcaagtgatccgcctgtctcggccttccaaagtgcaggcattacaggtgtgagccactgtgcctggcctgctgcatggattcttaagagtgattttatgacactctgagtccataatattttctataggcatactactaaaataataaagtcaatgatatgaattgatatataatactccatttagttattttaagagtactagaaagctttacatatctcataacctatcagccagaaacagttcaccactgaatggtctcataaacaagacagtagttcaatgacatctttaatttttacccatatgacaaaagctgagtatttcagagaattatacaacttgaaaaaccctgtttcattcaattgtcactttattgcaagatggtagaattaattacaaatttaaactataacctgttaatctttagtcaggcagcaagtttttataaaggcaaactgcttattcagaagtgatcacggaacaactcaaaggcagagcaagaaggatgagaaacatctgactggccgatagagatttcgttctctcactatatgaaacaaacttttcatttttaggaagggtaaactataacttcagtagacaccaacacagaaagactttgtcaaatagactagtttccatttagtcagtcaactgtttctagctgtctcaattgggatagatacatttacataactggctgtgcttgagccttctttgccagcagctttaggtccgcaatgcacttggcaattgtctccttttcctgtgataaggaaagagaaatctggttagacctttccaaaacatagaaaagtatagagtataaacaccattattctaaaagacacctcctaccagaccagaacctcaagatgattactggcttaacactatacagctactagacaggtttagaagtaaaattaattaacacagaggagatataatttattttaagcaaatccagggggttagttaaaattccctggctcacagcctttatgggtgaaacctgtatagaatttgaggccagatattcctgtaaccatctgccactgatgttggcttgtacaaccaacagttgcttgaaaaagaccaattcaacaaatattagtaatatataaatgttaagaatgaaaataatttttaatctcttttctagacttcttttgtattttctaagtttcttaagtaagcatatatattacttttatgtaaaagtttatcaaaaaaaaaaaaaaaactttgatagacactgtttttctaatcctgtataggttatgctgaaaacaaccagaaatacttaaatgttataaactcgagaaagaaaaaaaaaatcaagtcatattaaagcaaaaatataaatgaaaaaaaattaattcagtttaagcaaatagaaaacatttccgttcaaaacagacaagttatgcaggtgaaaagaagaaatggaatgtcatggaattagaaaatggaaggggcttagaaatagccttgttcagtcttttatttattttttgaggcagggtctcgctctctcacccaggctggagtgcaatactgcaatcacagctcactacagcctatgcttcctgggctcaagagatcctgtcacctcagcctcctgagtagctgaactacaggcgtttgtcaccgcacccagctactttttaaattttttgtagagacaggatctcgctatgttgcccaggttggtcttgaactcctggcctcaagtgatcctcctgcctcgcccttccaaagtgttgggattacaggtgtgagccaccgtgcccagcccagtctattttatagagaaattaaatatatcagttaatgttacccaaatttaaggaaagagaaaagccatcctgacaggtatgcagcatcttcctgcttatcactatccagaaaaacaaaccggggttacactgctacttctaggctaaagactccttgccagctattcctaccttaacaaaacatcagcagatacttgttaagagataccagtacaacatcagaacctacaaaaatgttgtgtacctgctgtgtggagatgctttgcaccacgtgcttctccacccaatttatcatgtgttcttgttcctttcgacgcatcatgttctgcacagatatatgatagtccaggcgattctttacttccttatatactctatacagtcgttcccggtaagtaacttccaaagccatagcaatgttattctggggcaaaattaagaaatgataaatattgtttgtatacttgaaggaatacttctactctgaagattctgccagtgagaatgcccacttcttttgtattttacgtgaaattcttttatttaataggtaatatgtacctagaaattataacagcatatggcaaaaacatatttaaaagtgatgctgtatgaaataagtctccttcagcctcccccataggccattaacttcctgtatttcttgtattccctcccagaaatatttaataaaaatataggtatacccatcaaaatataggcatatacacatcacttttattaattatgacacacaaacctacctcaattttaagttacactggattccactatactggtattctataattcattttttggtactacaaataatggtgcatacattgtagatttgtctttgtgtttatgtcataatacttgctggatcaaataatagttaacatttgtagagtactgactacactctaaacactcttgtgtttagattcaattaaaccttgtaaccaaaccatggcatagttattataattgtatccattttgcagtgaggaaactgaggcagaaattaggaaacttgcccaaggttacagagctaataaactgtgaagccaagatcagcatacaggcagtaaggctacataaggccaagctcttacatatctctacttggctaacccataggcatcacaaaccaatgcataccaaactgaaggctattggcaacaaggcaatcagaatgatccttcaatgactttctctcattcagagtccaagtcaaagttcttataggagcctaaggtctttatatatcacagtcccaggcctccctctatctccttttattctcccccgaccaattctacttcagctgtatgggccttcttacttttccttgactgtatcaagcaaacttccaggtttagggcatttgcaactgttcttccctcagcctggaacttatttccccaaaaatccacatactttgcactattagttctttcaggtgtctgctcaaatatcatattagagacatttcttgaatgccctataaaaacagtgactccctcctcctgcaattttgtagaaagggggtctatgttgcccaggctggtctcaaattcctgggctcaagtgatcctcccgccttggcctcccaaagtgctgagattataggcatgagccaatgcgcctggcctgcaatctttttaatactagtttatttttctatctggcatttattacctgttgacatttgcatctgttcaattatttattttctgtgcttctcccaaaggctggctagaaaataagactccatgaaggcagaagctttttgttctccactatattttcagcactctgccttgatcagaatatctacacaggaagaactcaataaatatctatcaagtaaatgtaaataaataaaaacctaaattactatcatttgactcttaggaaaaagctacattttccaatatggttttttaaaaaagccaaaatatatgtatgcatgcattcacgtgtgtgtatatactatgcaagaagcaggaagcattctccctttgtaacctaaatatacatggaattaacattttctgagattttcaaatatccatgtgcttaagagtctttagggatcttgtttaaaataatacagattctggatagcccctaagaaaggttctgattccataagtcttggaaagggacaaaaaaattaacaccaaagataactctaatccatgtggtaccaagaccacattggccaagatcctaaacatttcagatgcttagtatcttggccaatattgagaaatattggccaagatcctaactatttcagatgcttactctaccttagcatctcatttttcatttcattttaatataaaacttcaacataacagcacctcacttttaaatattagccataaagtacaaggctcaaaataaaaacagtaataacaaaatacttgaacatattcctaaagattgttttggaagctgcatattttagaatctaatcatgttctgaccatgataaaaagctctactgctatctgaatttgttgtttgtgtgtgtgtgtgtgtgtgtgtgtgtgtttgagagagtcttgctctgttgcctaggctgaagtgcagtggtgggatcacagctaactccagccttgacctcctgggtgcaagcagtcctgctgcctcaccctcctcaagtcctaggattacaggtgtgagccactgtgccctgcctgctttgtggatttagaatgtacagtatcagatttccttacagcaaagatgttaagatgttcttgcagcaagtgtgtatgaaatacacaggatgtattttacctagtcttccttacacagtgcatgccatttttaaatcagctttaacttaatgactatttcattttgtgtggatccaaaattttttttaatagcttctatagattctaattttataataatttgaactatttttccacttgacagttcttaaatgtttgaatagccgtgaatgccaactcctacacaaatcttctcttttctaaataaaatacgttcaatctatttaaccattcttcataaaaaattctgaattaaaaaaatgcacacaacaagtaacttcattcttcctagaaacttctgaaacctaccctttgcacatcaaaaaggtaatggcgcttctgaaccagtgcctgttgtgacttctccgtatcaattgcattctggatgtgttggatggaagcctgcttcgcctcttctagttgggcaagtttttgctacaattgtgatagcaacaacaaagatcagtgaaagcacaaagggtaaaaaaaggagattcatttcatgcttcttcaaagttgtatatctcatttgtaaaaacacccacaaagaaacatagaaagaaacgcacaaatccttaaaaagaattgcccataataactatagaatatcttttgaatgattaaactatagaaaagctaaagtgtttagtagatataaaaaaattatctcaaattagtaactaacgttaacacttatttgaagcattagattcatttctatatgttgctcccctaacactcatatcaaaaatatcactagatgaccttcatgtttctgctagtctaaaataggaaataaagtttatggttcttacctcattgagtttatcagcaaagtctgcaacaaagggaccatattttttaattccatagaccattacacctagtactgatagggcagtgaaggtctctgcgctaatcacatatatttctttggataaagcgtacaagataagcccagttccgagtacatagggtcctaaaagaagaaagagttattttatgaagggatatgctatgcctaaaagagggaagatagaaaggtacttctatatttgattagctgaaggcaaagtaatgacttaattagattcaaagacaaaacactggattgggaagcagtatggtagagttgaaagaacaaagatatggactcagggaaatctgtatactgactctacaattttaaagaaactgagcaatctaaataatctctgaatttagttccttatttgtaaaatggggacagtaccttcttcagtctgataaatttgagaaataatgttaagcacaataccccgcacagtaaattaaactattctacaaagatgtcagataactttctgaagtaatttgtccagcaaaatatactatttatcgaatgggacactagaccggataaaatttacacaagaaacaagcaaaaaacaactacaaagtgatatgtatataaaaggatgaataaatattaggattctcaattcctgtagcacctaattacaatgcttcaaatatggctttttctttaaccaggccatgtgttctgaaaggatgcaaaccatgatttacatttatttagtctttcctccgcgcctcacaggatgtaagggaggcccagagcaggcttttaggaaagcattttacagtatttctgagaatcataggatggcaggatgtatcataagaacaacagggttacaaactcaaatacattttacctggtttcccatacaaagttccaacagttttttttaactgcctttaatatacaaattttaaatatgaatttgcaagaaacatctatcatatgtaacattgttatcacctatggacgtctgaggagactaatgtttctagcaatttcagttaggaaaatgctactttaggtgactccagggctaaaaaaaaaacaatcttcggtttccaatgttccagtcatagcaatacttgggtatgggccaagaaaggcagtacatgtagtagagagaatcataaacttaatcaggggactcttgccttacatggcttcatttttattcgtacccttttcattacctaacagtatattatacagttactcatttctttattgtcatcctacaacagaatgtatgttccaggacagcaggcacttaacactgttcaacactgtatgactgcaacagtgcctggcataaagcaggcatcaaaaaatttgatctactaacaaacagagataatgctgtaaaattaagttaaaatcccaaataaatttataccaaagacaagttggagcaatcaaatcaattgttacaatttccttttaaaaatagctgacttgcggctgcaggcgggtggctcaagcctgtaatcccagcactttgggaggccaagatgggtggatcccacaagcccaggagttggagaccagcctgggctacatggtgaaagcccgtctctacaaaaaaatagaaaaatgagccgggtgcacgccaagtcccagctactcgggaggctgaggtgggaggatgacctgagcctggggaggtggaggctgcagtgagctgtgatctatcactccatcctgggtgatagagtaataccctgtctcaaaaaacaacaacaacaacaacaacaacaacaacaaaaaccaaagaagaaaacccacctaacttgattttagtggtgccatcaaaacatattaccagagactaggcaaaaatgctcacctgttacaccagttttaggataaagaaactggaagaattcctcagggatcagtccataacgaacttttcctccgtattcaggaagaggtggtacagggacaaggtgtggctgccctgtatgaaaggtccttgttgcctgcaataccctacaggtagtaattgtacaaatgtaaagcctgtttctttaaggagaatacagtgtatgaataatgagcagaaacaataaatagggttgataattgaggcagttttctaactctcataatggaaagagaatggactgggaatgggaaggttagggtccagtaatcagctgtgacaacagcaaagaattaatcacagacatttaaccttctacccaatactggaatcccttctatcagccttgcagatcatctgtctagcactttgtatgtctatcattagcactgaaatatgtaagaatgtggacgtggcggtcagataggcatcttgagttcaaatcctagacctgctccttgactttgagtaaagaacttaagcttttgtaatctcagatttctctcagtaaaatggaaatagaagataataccttatatggttgttgagaggattaattgagttaatatatgtgacgtgcttagaatgatgcctggcacatggaaaagttctacgtaagtggttagctattatatgcctgatatgttgtaagctcctggacctttttgaatactctctttgatgagagtgctaaacactatatgtaacagactttttcagtactgggtagctctaattatgttcatctttgaattgagatgatacatacattcttggaacctcaatccattcttagttctaattttgcttttctatgtaagataacacacatgtacctgggtcaaacatctgttccctcacaatcctgattgcccgtaaggacttctctggttttatcttttttttttttttttaatgaggtatacagaactgaatataatactttaagtatagtctggccaatttattcatcctacaaatacttattgagaacttactattgccagtactgagcttgaacaattgaactattatcaacagtggatttggaaactattcttgtattaaagcagcttaagactacacttttaacagttacagcatactgatgtctccttaagcttctgatgaaataaaatctagtccctttatatctgctgtcatttagtctccttcaagttttcagtgtatttctgtcccacttcctaccctccattcctccaatctctcaacttctatctccttgtaatataagaatttacattatttcatttattttggtacaatgcttatcttttgaatattatttctgcctccaaatatattagctaccccaccaggttttgaaatctgagaatcatgcttgagattccttcatttacatcaaggtttctcaattcagcactaccgacgtttgaactggatatttctttgttgtaagaggttgttctgtgcattgtagaatgtctggcagtatctttgtggcctttatacaataggtaccagtagcccctccctccccgacccatcctatggtaacactgaaaaatatctccagacattgctaaatgtcacctgcaggcaaaccaccccaggctaagaagcactgatttaaatcatagcactaaatggtatgcttaggctgacaagtctccctaactagctaccttagttcaagtccttatcacctcttgcttagtttaacaatacaaaacctggtctctctgcttattttatttatttttttgagacagaatcttgccctatcacccaggcgggagcacagtggcatgatctcagctcactgcaacctccacctcccaggctcaagtgattcttgtgcctcagtctcccgagtagctgagtagctgggattacaggcgtgtgccaccacacccagctatttttttttttatttttaggagagacggggttttgccatgttggccaggctggtctcaaactactgtgatctgccgtctcggcctcccaaagtgctgaaattacaggcgtgagacactatacctggcctctgcttcttattaaataccccaacttaaacctagcccactcacattactgccaatgtttctaaaatgaaaatctgacttgaaaactcaacaggctctctcctgcctacagaaaactacttaatataacatacataatctagtacctgtcatttttttttttttttgagacaaagtctcactgtgtcacccaggctggagtgcagtggtgccatcactgctcactcgcagcctccacctcctgggctcaagccatcctcccacctcagccttcccaatagctgggagtacaggtgtacaccacaatgcccagctaatttaaaaaatttttaaaaatttttgttgttttgtttttgtctatgttgcccaggctagtcttgaactcctgggctccagtgatcctcctgccttggcctcgggattataggcatgaaccaccactgtgcctggtcctgccaaattttataaccttatcttccttcattctcttactctcctggaattacttaacagctctcaaaaacaaacaaagaaacaccacaaaaaaattgccttatgctgctccttctgccttgtatgcccttcataccatgactttatagcaatgactatcaagaccaatcaggagcaatgactaccaagaccaattagcctccagatttgtaaagccctccccccattttgggctaacattcattcttttaatcaattaaaaaaaacatttactgactttctactaatgctaggcaccggtaacatggcaatgaacaaagctccagccttcaacattctagtgggggtatgggaagggtgagtgtgtatctccatacaaaatttcaggcagctctaagtgctatggagaaaaactgagcaaggtaagcggatagggagcaacaaaatggggaagagttttttggtagggagtcagatgacatttgacccaatcatctggggaaaagagagaagagcaagtagaaagatattgaggcaagaatgcgcttggtagttttcagaggaacaccaaggttggagaatgagctaaaaagagaccacaaggagatggtgtcaagagataggatggaatcaattcatgttggaccttctgggttatgctaagtttggattttattcaagtgggatggggagctctggaaggccttggtgggggattgacataatcctcctggctattatgagaatgggctgtaatgggacaagaatagagatgcaagactaattaagagactactaaaatacctaggtgaaagtttatagtggttcctactttagcggtagtggaagcagcagtcagagtccaaatttctagaggaagagccttgctgaggtactggacatggagtgtgaaagaaaaccaaggatattccttgtatcttgtaagtataagttatttactacctggtattacaattatttgtttaccagtctgtatggggtcctttttcttctaagttggaagcagtcaattatagccttactttttgcatacatgagacttaattatagataagaccactttttcaagtccattttttttcaatttgagttaccgtattttgcaagctttagaactaagtttggaagtaaaaagagaaatctctaggaaaatggacatgtcttatggaacaattttaacggtaacagctgctaaatttactaagcacacgctatgtaccaagaactgtttttgagtttcacagcaattgtctcttaattctcaaaagccacaatgcactattatcgccattttatagatgaggaaattgaggtcacacagccagtaagtggaggggccagggaccctgtactggctgtggagccctcactctaaaccaatactcttaaggtgcctcccattcctagactgtgagctccatgagggcaggtaattagccatactcattcttgtatccttggttatgtttttaggcaacataaatatttactgaatcaatgaatgatttctctgattgttatcatatggcagcaaaaactaggtatctgggaaaccgactgtaaacaacatgctttactgttttattgaacaaaatttattcttgggtatgtcatctactcggattcaggctgtggaagctacatgtcataaggtcccaagggaaggtcacaaaggagtagggcgggtatagaagacagcaaaaccaatttctagtttagttagaatacgttacttatcctgctaaaatcttggtcattaggtgacatgagagcgttcctggcagttacaggaacaagtgtcttgtctgaaagagggtttaagtgtcccaaaattatcggaaagaaatttctgacctaaagctaagggggtgggggcaggaatcgggaaataaaaggtagtgaaaacaaagacgaaagggagcattatcctcacacttaccctggacctaggaaggctgcattcttcagagagggggctgcagatagacaaggcgaaggtcagcaaagtcaaatgaaatctggtttgccctttccttacccccgccaggctctatcactaagcctatgtacccctctttcccgtccctcaagaccccacgctcccttccgaactgcactgaccactcgcctctcaggcccgtgtcgctgcgcccttctcccctccctgtcacccctagattcgcttctttccaatcactctgatagtccagagcagggtctataccccttacccgctgtggcggcggcggaaagtaccacccgggacagcatggtcaacgaaagtccaggtagcaatcttagcgtccctgtgaccccgataggagaatctgtcagggcaggaccaagatggccgctcacaagtctcgcgagatgaaaattttgtactcttccttcaactttccttgggagatttttaaaaaaaattatcgcgagaagagtcaagtaacgctgagagcctatcgcatgagggcgacagccggaaagcaggatggagccatagaagcaattctcgcgagaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccggtgagccgagatcccgggcctgggagctcccttaccccggcccagggcgcccctccccggagactgaccctcccagcccatccccgccctgcatgttatcctgaccctgggtcgcgtcaccgagctgtccccagccctgccccgcgttcctgagctcagatccagacccggccggaacgctgttctgtgcggtctccatggaggcgaacccttctacccttcacgcgctgacagcttgtaccccccgtagatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgagtcactatcccattatccacccccacccccgggtggaacggtagaatggagacttggggtaccgtagggttgagctcaatatctaacgtcctatactcagtgcttggaggagcctgagagtgttggccccgaatgcaaactcttgtgtaggtgggaaataccttttctaaaattctaaattgtctggtgagatttcctagaaaaatccgtaacaaaattaagcaacggattggaaccatttttcttctgtgtaacctgccccttaacccccacagcccagaccaagcataatcttgattttaagatgacattgaagccaatctgtgctacatgtctcttcccatttcttaccgctttcttgtcttcattctgctttctttttgttgactgttaggcttagcgatgcaggctttggcattttttttttttttaaatcagaatttggaagttggccggcattgcatggaagtttaaagtcccagtttttgatagatttaacctctctgacagttgagcttgaacactacataatcaagacaacttttggcggattctctatacttaaccagtcactgtgcaagacgttcaattattcaacatatttttaaagactctgcaagacatttattcaactagttcagcaaatacttactagtgtccaaatattggggaagtgttaacatcactggatagtgtgctgcttaaacagttgtggaaacttcatccttgtccccttgcagctcattttccatattctctcactaaaagcagataatgaattttacagactgttccatctttgtctttttctggaagctttctgcacctacttgtctgggctgtcattaggaaaacagtaacgcagaataaagtcaaagactcagaaattagctgaactctccaatgatgtggactttgcttttacaggaataactaacttactttgttaatttagtgacaatggctctttgaatcctagaagtgaattactgccttggtataatccaagctcatgttttccttaccctacccccaacaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctggtgggtccctgttctcattgctcctgtctctaagcctcctgtgggtgcctttcctatcctgttaacctcattaggtaacattttgggcttattctaagaatccagtgacttattttagcatgtctataaggtttccttagggattttgcagtccatcgtaagtagaccatagcagcagtccaagaggcaaagacttggggaatgttgattacaggaagttcttgtttgaacacgtttttatgttgatagtgtaggtcaagattaaatgtctgtttgcttttgcttcttagcatcaaggtttgggaccttgctcagcaggtggtactgagttcataccgaggtgagtattctttcatttttagccctggtgttagctgttgtgtttttggactttttgaactttgctttgatgttaggagcagcaattccatgttctgatagttttcttgtaaaacaatagtcaggctccggtatctactccttgtccttttctcaatttccttgtttctttctttctttttttttaattcgactagtcaagtgcagtagtgaaaagggaggaaagaatagaacaaggagtttaatctgtaactgactgaacaatcaactgagataactcactaccttcagaccagccagtttccctgtttctattgatggcctcaccaccttggcaacacagggctcaaactcggtccttttccacctcttctgttttcccaccatcggttggccactaagttctttttagtcttttccactggtcagtcaccttcctgtccatttctatgcccgtattcactttcaggctttaccttacacaggcagtggcactcatctctccactagcaatctagctcttttggtcttttattagtttcttgtggcctgtggattaaaatcccattttcttgtcatggcattgaagcccttttactccatttcctctcttcaagcttactagatccttgacattcttgagggataaatcttgagacttttaaatcttgaacttttgagtatttaccttcataaaatgtctgttttctggtgagaaccattacttttttaatgcccctctttctgctcactttcattaacagcactagtagttaactttatcttgggagccattctttgtgaagataatgtctagagccttaatgtgtacatggttccaaggtttagatgctgggggatcactgtggttctctcaatggctaagtgcctttccctgccatttctaacttcaaagtacatgactaagttataggccagagaaatcactgactcatatccaaggtccagtatcctggaccctcagggtcacttggaaatagttttacaataatgttgaatgcccagctgtgcgcagtggcttaacgcctgtaatcccagcactttgggaggctgaggcgggtggatcatatgaagtctaggagtcagagactagtctggccaacatgccgaaaccttgactctaccaaaaagtacaaaaattagccaggcgtagtggtgcacatctgtaatcccagctacttgggaggctgaggcccgagaagtgcttgaaccctggaggcggaggttgcagtgagtcgagatcacgccactgcactccagcctgggcaacagagtgaaactgtctcagggaaaaaaaaaaagtcaatgttctatgtctattatatttgctttttatttcttagacatatgatgtgctttcctggttaatgctaactctttttcagcatttctgccatgcagcctttttgttagttctttgtgtttgtgtcttattccccctgctgaattccaaatcctttattatttttctattttttgtagagacagagtcttgctatgttgcccaggctggtctcaaattcctgggctcaagtggtctcctgccttggcctcccaaagtgctgagagatacaggcatgagccactgcaccctgccccaaaacctttgagggtagaggaaccatgtattcatcttttgtacaccaccatggtgcttgtcccagagctttgcttttttcaagtgagcaataaattccttttcttacttcttatcctgttggctttctatgaattctagggctaggaaagaactatggaaactggtttaattccatccttctgcctcagggaagggccacattcagactacctgggaaagtctggtaaaatgactgtagaaaaggtttccacagcttctaattaacatgtagcagtgactttaaagttttttacatgtagacctcctaaaacagttttgaaaatctgtgccccctcatacatttttaaactgatacctaaaaatgcttatttaagtagttgcagagaaggtaatttctggcatataatttattgtgtgcttatttcaagcatatatttgtcaaaattttagattcgcaggttaacgctacttagtttgcatgaatgtctaccaaacagcctaactggcaaaagccagtctgcattgtaaagccagtggaccaagatagactaaattttctgtcagaaaaagtctgactttgtttttaaattcagataaagttgttgaatatgtccttatcacaatgatctatcatattttttagttctcattattagacagaaacagagttaagtcacagagccatacttgtgtttgtggtgtgactgaaacaagatcagcccccttcattgaattttacctagatgctctttctttttgctctttggttcttatggaaaagccccttttgtcccttagtttagaacccttatatttttatacccctgagcattgtagcgtggaaagatctgggatgaatgacaggtatgtgttctttctatgaagtgggagaagagtgattgaaaacagaggcagttcaattttaagaaagagaacattagagaaattggctctcttaatactattagcgcccagaactccctcaaaagtttttgtatactacttggaggtgtgtgtactccagtatgaagactgctattctagaattatttagccctcacgtctaggatgcctaaactggaaattcctttgttattcttactaagcccctaatttctcattcattatcttcactaatacgttttttttttacaaggctttttaggttttataagtctataaacttctcctcttagcttttgtctaatccataatctcccacaaaatttgttaaattgcatcatgagaccagccctccctccctcctgccccttgattattcctgggctggccctctagtaatgcttcagcttgttttctatcatatttctctttctctctcctttatagctcatgctgctcaggtcacttgtgttgctgcctctcctcacaaggactctgtgtttctttcatgcagcgaggtaagagatagctccttcttccctaaacacactccagccatccataggccaaagtctctagtggggagactttctggcctgcaactgctcctttggattatgaaatcctttttctgttccaccttcctctaggacaatagaattttactctgggatacccgctgtcccaagccagcatcacagattggtgagtctgagattcattggtgggagaatagtacttggaaccctgatagaagagactgtctttggccagtgtcaaagcatagttgctagatgcccagtgtagttactgtgacatgagtgacataatctccttcttttccagtgaggctctgctaaccccattctgtgcaatgaataccaagaggaagggccagttcctgggtgggtgatttactttattagatggtaggacaaaggggccagaattgttatcgtcatgattcgtgcctgaaacttgcctgtgactcgtgtccagaaagggcaggaggctgctgggataaatggttatgaggctcaaggatgaggacactgctgccttagcagggtttgggaaatcaaataaaggtgctcccaggatttagagtgatatcatttgagaaactgcttcttctgtactctgagttttggtccagaccctcgtctctcctttgcaggctgcagtgcgcctggctaccttcctacctcgctggcttggcatcctcagcaaagtgaagtctttgtctttggtaaggcagcgtgtcagacttcatattgactctgggaaaggggaggaggaaaaagaaagagctgactccacaacacacaaggcccttgttgctcagtcttagccctcatggacactagatgaattatgaattgagggtggggaggtggggtgatgccaacgtagttttagtgtagttttggagaacatgattattttcccagtggatttgatttttgattgattgatccagcttctgtattctgggcatggctataagtcagtgatccacaaagcaagtggattgctatatagcgaattctgtcctactgtgggtaggtgtagcgctatcgtggtcatgaggctgtgtatatggtgacatagtttgtggttaaaataataactgcttcgttcattaacttaattttcacaatgatccagtgacttattattcctactttgcaaaagagaaaactgatgctcagaatggttaacttttacaagctcgaggaactaggattcaagtctttggcacaaaagtccatgctcttaatcactatgacatgttccttctcttctacaggtgatgagaatgggacagtctcccttgtggacaccaagagtacaagctgtgtcctgagctcagctgtacactcccagtgtgtcactgggctggtgttctccccacacaggtactgttctttgtcatcaggggcctgatgggtataaatgggaaccgtgagggtgtgtgtgtatgttttcaaagcattagctgatgaagtagttccttaaagcagacagtgttctagctgaggtttcggaacatcgaagatctcttaagtgtgaagtagaatcctttgggagtcaaaggatttttcagattagatggtttctgtctgaaatggctaaaatgtgatttcattcctgcccaacacccaaaatggttaatgttgtgggcttctaggactgtgagattggaaaagcctgtgtttctgggttattgctgaagctatagagagggaccagatggggtggttagttgccaggatggttgtcaaccctaactttgcttcatttccctcatctttacttgaaacttttagtgtggacttgtagtagccagattagccaaaagtgggaatcaggctgcctctcctgggtcactttacagtggcggcagggccggcccagttaaggttttgtcttgggatccaggctggacctttcacaaccctctcctccatctgatagtgttcccttcctggcctctctcagtgaagactgctcacttgctgtgctggactcaagcctttctgagttgtaagtgtgaagtggaatcctttgggaatcagggaaggggagcagtgggtgggcgagtcattttcctcttcagaaaactgtgttgtgcttttggagaacagattctccatctgtatccgaagggacttggtaatggaagcaggctggctgttgaccctgtccattcctggggcacattcacaaccccaaggacaagccgtgtccttggtagaggggggtggtaggtgaaatttttaagtctagccctccagcgctctcccacaagggggcggcagtctaccctctcacataaagaactgcgtatgaaatgcagcctgctacagggtaaaaggcagcacctggaagacctgaattgtacttccctccttgccgtgatttgctgcctgttactgcccctcatcactgtcttgttctatccagcatttcttcatctatgaaaatagaagactggattggatgactgatgacatccactgtggatagctacactgctatcctggcgatgaggccatacagttggtgaaatgtgtgtaacacacccaaaaaatgtgccccagatgtgttgggttctctttttttctccaggtctgcttttcttgtctctactctgccccgactttttttctttcttctaggtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccacaggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgaagcatgtgtgttatgtgtagttagatatatttcacttatgtgagtcatcatggtgttggtcttgtagcccattatttttcctgtgcttccccagcttcccaaagtagctagttagaacttaaggtaaatatttattcttgggttggtggagtggatattgccagttaggagtcatggatcaattactgattatattgaaagtaaatataatcaattatgtacttttgagctttgcaggttcaatttaggtaaaaatcacattatgaaactgggaaagtctgaaggaatatgggcaaaatatttctcagtaaagcttccatgcttcacccttgacatgattacccttgagtaaaacatgggaatttgtagttgtgtgatcctctggcgttgatgtggagtaggaataaagtcttgcatcatttttataatgtgggaggaaatagaatgggtaggtacaatcacttaagttctgcctctcgaagataaaactttaattttgtggacacttagagaaagtaaggggtgggggagcttgaggtgagtaggaatttgcatagcccttttcttcctggacttaagaatgatggagaaaaaactcagtgaaagagataaggaagcaaatgtgtggaaatgtgtgataaggaaggaaatgtgtcaaggtggttacaatatggaagggaagcataggttttttttttcttttgttgagatggagtttcactcttgctgcccaggctagtgtgcagtggcatgatcttggctcactgcaaccttcgcctcctgggttcaagcaattctcctgtctcagcctcttgagtagctgggattacaggctaatttttgtgtgtttagtagagacagggtttcaccctgttagccaggctggtctcgaactcctgacctcaggtgatctgcccgccttggcctcccagagtgctgagattacaggcatgagccaccgtgcccgaccagaaagcatggtttttgaaggaccatattttattgtaaaaaaatgttttggttcagatagatgtgtgctgatgggagtaattcacatctatcagtgaccaccaccaagatatttataaaccttatcaaatacagtaggaagagcaaccagcacaattttggataaatgtatatgttgcagtgaacaaagaagatagtttaaaataaaagatgaccacagaataattagaaatggtactgtcacatatggagtgatttgctacgtccttcacttgaggatagttctagtagagtgagtgcagagctgatgacaagttgaaatgagatcaatctatttgtttaaaaatatacaaatattttgcatttaatttcatcggttaaaatgtctaaacattagagtaaacccatttccctatctacatccttactctgaagtccactaatcaaacctactcttccacagctgttctctggtccaccaagggctatgaggctcaccccttggatggtgctcagaaccacaaggaatactgaagaagccttgcctatgatttcaggtggcatcagacattgggctaattttcaaggtgtctctccttcccaacaggacagtcggagtctggttctttaataaatagctatatggatcttacttactggttcacaatcatattacagcagcaaaaacacccaagctctaactgctctgggcctccagccatgtttcctccagatagcatgttagaaaggacaggagattttaaaaatcagattggacttcagagggctccaaattttcttgccacatctagacctgaaagtaaagagctctgattattaagaggcagattctcgttgcatttggacagcgtgagtaatggtcacactgaacacattagaatcagttgtgaaattgattttgtttcaaaaaaggataagcaagctgtagtctcaattttgagttaattgaaatttctcaagaacttcatcagcagctcacatgatacagttttggaagagtaaacaaggtaagcagacaaccctgggaccccaaacacattttcttttttagttctccatcaaaaataggcatttctggagttttggtctcactgagtgatcacaggactgctgcaatccagggaactgagggagctgtgagcatctgagaagaaaggttagctcttgttttaagttgtagagacaacttaaaacaagttgtgacacaattagtgatcccataatcttttatcatctggtacaacatttaatatagtagcattctacttactgtggaaactccttg

SEQ ID NO: 15141 - DNA, 771 bp, Homo sapiens
taggtgttttataattttttgtttaatcaatttgaaataactgctgatccaatcaaattatctttaagtaacaaagatatcaatctgatttcaatattagattagtacattagctaccaatattgactcaaatgattattacataaaatcttaggaagtcaatgaaaatagcaattacccatgataaatattttcaaatatttcctattgcgtaatttgtccatttgaatacaaataaatccttgtacaagtatgggagaatcaaatgcagataaacctatgaagggaagaattttctaatttatctacaggatttttcttcaatttaaaaaaagattgtaaaatacacataaaatttaccatttttaagtgtaccatttaagaacagtattaaatacatccttaatgtgccaccatcaccactatccagctccataactcatcctgtaaaactgcataacgtcctcaaggttcattcatgctgtagccagtgtcagaattttcttccttgaagtggaataatattccattgcatggatatactacattttgcttatccattcatctactgatggccgattgggctgcttctatgttttagctattgtgaacaatggctgctatcaccatggaacacaagtatctcttcaagaccctgcttttaatttttttgagtatatatgtcgactgggattgctggatcatggtatttccattttaattttatgaggaatcaccacacttttccataatggctgtaccatttcatat

SEQ ID NO: 15142 - DNA, 932 bp, Homo sapiens
tgagtagaactgatgtatgagaccctttaagaccattatccaactgcagtttgcttggcagagttagcattaatgcaccctttgatctaggcacctggaggcaggtaagacaggctctgcgtgcaccaccgtccctggacctgttgtggcggactccttgaagcaagatcaacttgggctttgtttgagtttttaaagtcttttttttttaatgtaaaatttgtcattttaactttttaagtatacagttcagtggcattaagtttatttgcatttttgtgcagctttcaccacttccatctccaaaactttttcatcatcccaaactgaaactgtacttattaaacagtaactccccttcctcaagaccctggcaatcaccattcatcttcatttctataaatttgactattctagacatacgtgtaagtgggagcatacaatatttggtttttttagaggggggttctggcttaattttataaggtgttaacttgttcctcaaaatgtgttctataaactggcagcatttgcatatcttggaacttgcttgaaatacagaatgtccagatctactgagtcagaatttacattttcaaaagcttcctacgtgactcatgcatattaaagtttgggaagcactgacttagattaccttttgagaattccagatgggtcagaaaccagacagaaatactcagtagtgagaagctatggtgtatcagaagctgttaggcatttcatggtttggtagtgagcaagacagatagttttcctgtattcagcgacttagtctagagagagacaggatggaattaagtgtttaggtgctagccaaaagtaaagattcgtagaaaacaagggttcatatcccagtcatcaaagtgataaattttccctgcttaacatttagattaaaaagtaataattag

SEQ ID NO: 15143 - DNA, 4282 bp, Homo sapiens
ctgatggttaattttagacatctacttgactggattgagagacacacatagctggtgaaacacaatttctgggcatatctgtgaaggtgtttctggaagacactgagataaccctgacccagtgtggatgggcactgatatggtttgcctgtgtccccacccagatctcatcttgaattgtagttcctataatccgtacatgtcgtgggagggacccagtgggaggtgattgaatcatggtggttgttactgccattctgttttcatggcagtgagtgagttctcatgatccaatggtttcataaggggctgttcccctttggctcagcacttcttcttgttgctgccatgtgaagaaggacgtctttgtttccccttctgccatgattgtgaggcctctgcagccacgtggaactgtcagcccatttaacctctttgttctttataaattgctcagactcaggtatttcttcacagctgtataaaaatggatgaatacaggcaccatccaattggttgagagcccagatagaataacaaggaagaggaaaggtgaattatctcctgaaattgaaacatccttcttctcctgcccttgacatcagaatcagtgtctcagagctttggcctcagaatcagagttacaccattggcttccctgattctgagtcctttatatctggagtgagtcatgctgccagctttcctggttctccaacttggagacaggctattgtgtaacttctcagcctccataattatgtgaaccaattcccctaatgagtcttctctcatctatctacatatatcctattgattctgcctttctggagaaccctgactaatgttattacaataatacaaaattcactagtttatatagaagacttggtttttgtctttgccccattttgtatttgtattataactgtgtatctggaaaatggaacaagtttttatcttcttcatatgagggccaaagcttttttctcaccaatatttttggagatttttaagattttcttttgtttggacatacaatcttatggaggctgagaaataaaattttttctattttatttttcagccccagatgtttgcttttgcagattcttgagcacattgagagcatggagagcactccaaggcatggagtgggatgcctaaagtttcagtgattacagggagttgagagactcaactgggaaaggaaaagtctaaaaggaggcaatttggaagataaaaattttctcaaaggagcgattaaatttctaaataattcttagtaaaatcatgtaaacaggaaaggaaatagaattagttccatattggtggaacacatagcagaggtttgagaagggagaatttagtcaactgagaagttctcatgaaaggagcaagttgaagatcacagagacaccttgaaacaaaaagccaggaataacttccaacccaagaggagaacagagaggcctcaaaaccaaagctaggataagaaacttgtagcccaagagttatcttccagacaaagaagcctgagattccaacgcagcttcagagagtactcactcaaaatgttactgaaactgaaggctttttaatgacttagccatgcatgcaaaaggcattccctaaggtggcacagaagacggagcccccatatccaaagatagccaaggagaaagaaagacccctgttgccagagccagtgggcaaaggcaacagaaaaggagacaagggtcctaatgggatgagatcctttcggatttaggcttttatacaaactcctgagaactggcaggttgacagccataaatggggtaccaacatttctactcattggattacaagttctcaggcatccaaaatgatgaacaaaatgacaatttctagggcttctgtgggaaagtatggaaaggtctttttgaaccttttaatgctgtcaacggaagaatgatgaggttcataaatttggaaaggagacatttcttcatttttatgtttatttttattttttttgagacagagtttcactcttgttgcccaggctggagtgcaatggcgtgatcttggctcactgcaacctccacctcctgggttcaagcgattctcctgcctcagcctcctgattagctgggattacagatgcccaccaccacacctggctaattttttgcagttttagtagagacagggtttcatcatgttggccaggctggtctgaaactcatgagctcaggtgatccacttgccttagcctcccaaagtgctgggattgcaggcatgagccacccaaccagtgagagatttatttcctataaagggttgtagcctgcagggttgtccttctgacaggctgggaagcatagcctccagccagaagccagaaacagactcttcaaggaggaggtaaagaaaatagcaatttatgctgactggaatggccaaatacatttatttaataagctccaggaggagtcatgaatatttatggaaggagaaatgcatgcatgcacaattgagtttctggcttcttcatgggtcccatgtacaaaaaatggcagtgttagcatgatcccagggtgcagttttcagccctctgacattaaaaggtgaagcagaggacatgaaaactcgctctgtgcatcctctgtacgctggccagaacctctctgttgtgggtggtctcttatcaggcaagaaaggagaggttgatatcggtagtggaggctttgaaagggctggtttctgttaaatccttagggaagaaagcctcatcatggttagcaaaggagtgggtttaacgatgtgtatgttaaccccatcatcccatcctagcaaagctgagaactcagttttgaaagttactctgtggtcccctcagccaagagtggttctgttcagtcagttgggagcttataatttaatttttgtttatcaatgctaatgcgaaagagtacgctgtcttcatggcagctgaatttgcaagaaactccttggatggggttaatggcagctgtatttttctgggagctctgctttaattggacaaagtaagttgtggtaagatttcttcttttatcttcagtatctcaaatgttttcatttaaataatctttataacaacttttgatgtctgagtggattcccatacagtcatctattgtaagactttctgattccgtttttttcctttggtcattatgaatagggcttatgtaaataattgcatggtagcttttgattggaagtaacatcaaagtagttgtcaaaatacttaggaatgttatttttggattgtaaggtgagacttgtttagctttggaaaaaaatgcccaacttgtaataggggaggaaaaataattttctgtttttggaattcttagatgggatgctctgtaaaaactgacagattaaaatgagaaaaacagaaaagttgaaaaacacgtataccttatggttacatgggagatattcagggaaaaatgagtaaatctccaacaggtggctttcaattcaagcataaatactgtcttcaacttaaagaaagaagatttgaggtgcagtattggggagttaaccagcaaaagcacattagacaagggtaaggttcattatacagacttaagtccatgcattctccattgataagactctttagtgatttagttatccttctcttcttggtgtcgagagaggtagcttttaaatggtgatttcctttatagatgtaaattttccttacacaagtgtaacttctctgttttcacaacttcctttgttagcatttttttttttcaaaataattagcttggaataattcttaagccaaagggacatattttggggttgcatattctggtttcctaccattatattttggggtggcatattttggtcttatacactgtgttccaccggcaatgaaaagagttcttgtttttcctccagcaatttgtcatttgttaaagagtttagcagttctaagagatatagaccagctgtgctatctttttgtggttttcagttctctagtatgttgagcatctttttgtaagtgtacttgccatctgtagatcttctttggtgaggcgtctgttcagatctgtgtgcatttttaattgggctgtttaacttattgtttagttttaacaattttttatgtattttgaatacaaattctcagatctgtattttgcaaatattttcttcaatatgtggcttgtcttttggttctcttaacaaggtctcttccagagtataaactgtaaatattaagaaa

SEQ ID NO: 15144 - DNA, 10821 bp, Homo sapiens
gctgtgctcttggctcaccacaacctctgcctcctgggttcaagcaattctcctccctcagcctcccgagtagctgggattacaggtatgtgccactatgcccagctacttttgtatttttagttgaaatggggtttgtttacgttggtcatgttggtattgaattcccgacctcatgtgatctgcctgcctcagcctcccaaagtgctggggttagaggcatgagccaccataccggcctttttttatttttttattttttttgaggtagagtcttgcactgttacccaggctggagtgcagtggttcgatcttagcttactgcaacctccataatctgggctcaagtagtcctcccacctcagcctccctagtagctgggactgaagctgtgtgccaccatgcctggctaatttttatattattaggagagatggggtttttctatgtcatcctggctggtcttgaactcctggactcaagtgatcctcctgcctcagcctcccaaagtggtgggattacagatgtgaggcagcatgcccacctttcttgatttttattttttgagacagggtcttgcgctgtctaccaggttggagtgcagtggtgcgatctcagcttactgcagcctccacgttctaggctaaaacagttgtcctcccttagcctccctagtagctgggagtacaggtgtgtggcaccatgcctggctaatttttgtattttttagtggagacgtggttttgctatgtccttctggctgctcttgaactcctgacctcaagtgatccacctgcctcagcctcccaaagtgctgggattaaaggcatgagacaccgtgcctggcctatttttaactttttgacgaaataccaaactgttacaaataggctgcaccgtttatattccacatacagtatttaatggttgtgatttctctctgaccttgccaacacttgctgttttgtattttttggattatagcttttctagtgtgagtgaaggagtatgtggttgtggttgcagtttcgatggccatagtgataatgatattgatcatcttttcatgtgcttgttttccatttacatgtctttttggcaaagcgagcgttcaactctttctccatttgtaatttggttgtctttgttgagttatacaagttccttatatattgtggttaacagactgttgttagatatataacgtgtaaatattttcttcctttctgtgggttgccttttgattttttttttttagactgagtcttgctctgttgcccaggctggatttcagtggtgtgacatcggcttaccgcaatgtctgcctcctgggttcaagtgattctcctcctagcctcccgagtagctgggattacaggcatgggtcaccacacccagcaacttttttgtatttttattagagactggatgtctccatgttgatcagactgtcttggactgctattcacaggtgatatgcccgcctgtgcctcccaaaatgcttggattacagggggagccaccacgactggccagttttttttttgttttttttttgaggcagggtcttgcactgttgccgaggctggagtgcagtggtgccatctctgcttactgcacccttcacattctgtgctgaagcagtcctccttcctcattctccctagtagctgtgactacaggtgtgtgtcaccatgcacgactaatttttgtatgtttagtagagacggggttttgctatgtccttctggctggtgttgaactcctggactcaattgatccacgtgccttggcctcccaaagtgctgggattacagacgtgagccaccatgcctactctttttttttttttttttaaagacatggtcttgtgctgttcctcaggctggagtgcagtggtgccatcttggcttactgcaacctcgatattcggggctcaagcggtcctcccacctcagcctcactagtagctgggactagaggtgtgtggcagcatgcctggctgatttttgtatttttagtagagacggggttttgctatgtctctctggatggtcttgaactcctgcactcaagtgatctgcctgcttcagccttccaaagtgctgggattataggcatgagtcaccttgcctgtcgtgtttttaactttttgtggaaataccaaactatgttacaaataggctgtaccattttatattccacatacagtatttaatggttgtgatttctctctgaccttgacaacacttgttacttaatatttgtggattatagcctttctagtgtgtgtgaaggagtatgtggttgtggtttcagttttgatggccataatgataatgatattgatcgtcttttcatttcctcgttttctatttgcatgtctttttggcaaggtgtgagttcaactcttccgccatttgtaatttggttgcttttgttgttgagttatacatattctgtatgtattgtagttaatggacagttgttagatatataatgtgctagcaaatattttcttcctttctgtgggttgtctttttgctttctttttttttgagacagagtcttgctgtgttgcccaagcgggagtgcagtggcaggatctcagctcattgtcacctccgcttcctgggttcaagcgactctcctgcctcagcctcctgagtagctgggattacagacgtgcaccattacagcaggctaattttgtatttttgtttgagatggggtttgtttatcttggtcaggatggtcttgaactcccgtcctcagttgatcctcctgcctcggcctccagaagagctgggatttcaggcatgagccaccgtgcctggccctaatgtttgtatttttagtagagacaaggtttagccatgttggccaggctggtctccaactcctgacctcaagtgatccatctgcctcagccttcgaaattgctgggatgataggcatgagccatcataccatgtctttttttttttttttttttgagacagggtcttgcactgttgcccaggttggagtgtagtggcacgatctcagcttaatgtaacctgcacgttctgggctcaagcagtcctcctgcttcagtctccctagtagctgctacttcagctgtgtgtcaccattcacagctggtttttgtattattagtagagatggtgttttgctatgtcatcctggctggtcttgaactcctggactcaggtgatccacctgccttagcctcccaaagggctgggattgctggcgtgaaccacagtgcgcagggtttagggtttacagtttagggtttagggtttagggttagggttaggggttaggggttaggggttaggggttagggttaggggttagggttaggggttagggttaagggttaggggttaggggtaggggtaggggtagggttaggggttagggtagtgtaaataatttcacattattactaataacaaattattacttatattacactattacttaatgtaaaggctattaagacatgtttgtcttcaaagaatggcgttggtttctgtgggcagtttctcctcatggaaaggtagtgcgttcctgctaaatcatggacaaaatgggcctccaggagctacaggctgcagaagcagcttctcgtctatgtccttcactgcctgatactgttgttgaccttgaaaccttgttttgggctagttttattaacagagctagtatttccatgaggttctactacataccaggttccagaaagctaaatgccttttgtttgttattattcactaaatacaaatcacaactctcttctcattacacacacaacaaaatttagctgagggagattgagtgactttcccagggtcgcacagctactaagagcagagtcatgtttagattcatgtgggaatactgaacacagaaatgaaccaacggaaacatcctacattccaaaagcctactcaagccatttgttcttattttaaggaaaatctatcatgaatgccaacatacatccctaacaacccagtgctgttaccctccaaacattttatgtcttgcaaagtattagaacttcatatgtgaagccataccactcagagggaatgcaaaatacataatgacatctcctttaggatgtccttagagaattcaaggaaaagaagttaaataatttaaaagtgctttcgggtacagctatttagcactagacagtaagattagacatagattgtaaagataataatagggttagggataggattaggatctgggtcagagtcagggccagaagtatgcttagaggtggggtcatggtcagggtcaagatcaaagtcagggtcaaagttagggtcagaattagggaccagggtagggatcaggatttagattcagggtcaaagtcttgggacagggttagggttaggattagaaccagagcttttttctcctcaggacccacccgaggacgggtcaccatggctttggagcacctggtagtgtggcatgtccacagtgaagaccagagtttcgttgtccttaagactgacctggggagacgtggctgcaggccattgaggaaggtgaggaaaaacttcctgtctgctccccgtgtgctgaggagggagctctgccatgggctttactttcacatgttacattccacaagtcttgttttacaaaagcatcccttccttgaggcttcggctgctcatcactgctcatcatcataacgtgccataacatacagtaagatttgggtttgtttctggggagagatcttggtatagagaaaggagaaatgcttagagccaccatcaggacagttgggatgaaagctggggttgggcagaggctggaggaaacatgtgcaccccctgtaaacacttttattcttgttttaattactcatttttcttacagtgttaaattagtaaaaatagtattgaaaaattgaaaagtaggcgtattaaaacttgcaacaccacttaagcttagatgtattatttgtacctcaacattttttattttgttgagaaagtttaaggttaattggcagcatatttctaatagtagatagaataatgtctgttttataaacattgacatcctacattacatgtgtcaaccctgaaaatctgagacggctctcagattttttagaaagtttattttgccaagcttgaggatgtgcgcccatgatgcatccttaggaggtcctgacaacatgggcccaaggtggtcggggcacagcttggtcttacacactttagggagacatgagacatcaatcagtatgtgtaagatgtacattggttcagtccagaaaggtgagaaggccagacagggggcttccaggtcataggtaggtaagagacaaacgatttcattcttttgcattgctgattaccctctccacgtgaggcaatcaggtatgcatttatctcggtgagcaggtgggtgtctttggatagaatgggaggcagatttgccctaagcagttcccagattgacttttccctttagcttagtgattttgggtccccaagatttattttcccttcataaggttttcctatgagtattaattattcattgtgtattttattacacaaataaggcacagatttttaaaaaatcatcaacttcgtggctacctatatagacataattgcatagaagttcaactaaatttgcaaacatcccagaatttgggtttccaataattcttagtgattctttaaaaggtaaagtatttttttcccataaaacatagcaacatgtaaaatcacccgtagaatgtcccgccatttttgtttttctagtttcctcattttctgcaaagcctcactgaggagattgactttgaatatccttttacactcttctgttttagatagcattgtggtaaaacattgaatcatcatggtcataagttctgtccacattctttctttctttgaatattttttcccagtgagcaatatttgattctgctgtattatggctaaaaggtaggcatggcaacaaaataaagacaggaagtcttcggaataagtgatcccatcacaatgaatcaatttgccattggaacatatttttacaaagtcactcttgtgaaaatatttggctatgaattgaaacagagtctgtaaggttaatatttttcctggtctaaggtgaacagcattttagagaatgaacccaggacacaaccacagcacaagaaaaaaatatgagaattaagtttacacatgtgtgttactacagtaacagaaaacatgtaaagaacatttgttttgatttatatgtcagtctgcactgtttaattttttgtgtcataaatgctcttatttaaaaaaataggactagttaacagtgtcaattactagtaattcatggtataaataattaaacaaggaagtgttcaaaaaacagtgttttaaataaagttttattttacatctttttacttacacagaaattgtcaaaaaaaaaaaaaaaaagatttcccatgtagccgcaacctagtttcctctcttattaacatcttctattagtgtgtctcacatggcttattaatatcttacacaatttgtcacagttaatgaaccaatactgatagactaaagttcatatttcatttggattcccttagatgtgtcttactctgatccaggatcccatccaggatcccgcatgacatgtagtcatcatgtgggctcttcctggctgtgacagtgtgtcaggctttccatctcaggtgaccttgatagtactgaggaggattggtcaggcattttgtagaatgtccctcattgtcacttcatgttctcaaggtgaactgttacctttgatattcacttggatcattttgcagagctactgtttgtcaggttagggttggaattcttttgcaaaggagatttctatgcaactccatttgcttattcacctatgcatacaaatacagacacctagataattactttaagctttagctattattcaaccctgcagcattatgttgcacaattcattcctgtgttggcaatcggtagcttttttttattggctcttatttttctttgatatattttaatttttttagtacttacttactttctgatacttccagattatcctggctcctatatttactctcccagttctagtatcagacatttcttcaaggagcctgattcctttcagaatggtaggaaaacttacgtctggctgctgaaagagcacattgtatcttgtccctcattagtaatgctaggaagtatatgtgtgtgtctaacctacctatacacacctaattataaagttttctatgtagaactgtgtgtatctatattaaactaaacataagtttacgtttatgtctccacctctgatctactatcacatgaattattctagccttgtcgccttgctaatttgtaacctcccacttcaacagtgagaaacctggttcccaccatctgcgacttaatgtaagtcattgttttattccagatacagacactgtggttttacagttgttcgcagttgcttctgttggaaagaactttgtaaaatggaatccaaggatgaagtatagttgatttgccttcagcttacagattctattcattttcaaagtgacttaggtcaacaccattttccctacaccttcagtgagtttttacttacatttgtgtcttagtccattttgtgcttctgtaacagaatacctgaggctgggtaatgtataagtaaaaaaggttcatttggctcaaaatactggtggctgcaatgtctgagattgggcagttgcatctggtggggcctcagtctttttcacctcatgatggaaagtggaaggggagcaaggtgtgcaccagagatcacatagcaaaagtgaaagcaagagggaagccaaggaacccagactctttttaactagctactcctgtaggaattaatccattcctgtgacagcagaactcactcacccccatggaggacattaatgtattcatgagagatccgtccccatgacccaaacaccttccactaggccacaccgccccacactgacacagtgggggtcaaatttctcaaaaagaaataaaaatttttttgagactgggtccggctctgtcgcccaggctggagtgcaaatgtgcagtctcagctcactgcaacctctaccccctgggtgcaagcgatcctccctcttcagcctcctgattagctgtgactacaggcacatgccatcatgcccatctaatttttgtatttttggtagagatggggtttcaccatgttgcccaggctggtcttgaactcctggcctcccaaagtgctgcaattataggcatgtgccaccatgcctggctaaattatagttttccattgaaacataaaatttctctctgtagtaaccatcatttttgatcataatcaaagtaagactattattgttttaaaaataagtctagttttgttagattttgcttgattatttacataagtgcagcaagaacaggagatgaccacataggtgctttcaagtttctttgctggaagttttcatacagaatctcagatttgacttttaaaggccttattcaggctaaaacccaagccaagcacatactatcaaatttcagccgcagtccttatggctttgtgtgaattcctctcttcttgaggcccccaaaatatccccaaattcctgggcctaccgggaaatgaccttctttactaacctgaaggctgtgaaccctgtaatctaggtatcaggctggcttttctcagagtgctgttgggaatgaagattttggtgttccaaaaaaaaaaaaaaaaaaaaaacaacgtgggaacaaatgatgtcttagcgaggcgagctttactttctgcataaagggtgctactcaatagctgtccagccacaagagcacaccaaacaaaggagacagagttacttataacctgatgtgtctaccctagtgctgtgtccagtttccactggctgaaataggacctcacattttacactttacccgattgactattagtttaacactttcttaattaggtaaggggaatagaacaaagaaagaaaaggaagttgcccagggatagttaaggaagcatctccaaataaggaatggcatgtattatgggctggggcttgtctagttctgcccaggcatgctggagcaagctaggacaactgatttggaatacacacacacacacacacacacacacacacacacacacacacacacgtatatataaaaatagtggatagcaatctcaaagtaagaaattagctaggatggtctggatctcctgaccttgtgatccatcctcctcagcctcccaaagtgctgggattacaggcatgagccactgcacccggcacaatatttaaaataataattggaattatgactcattactctatactggcacatagcatggataaggaggacataacaaatttacaggaattttatatcatttctgaaaacataacattttacccatacaaatgtaacacagggaaggttaggtatctctttttatttgtatcttatgtatggttttccttataaaaaatacatcctactttacttgtgaaacatgccctacttttcttgcatgctttgcatggggttgtttctagttattccattatttctaatctttttatttacatatactgattataattttaatacttagtaatcttttattttccagagaaaactaggaagtagtcagttataaagtgtcatatattagcattctatagtaggttagaaaaagtatgaatatactgtctcccaacatctagagggatgtatttcctcataatacaatttctcagtgtggcagaaaaaaacatgtttattaacgggccaaaatatctttagtctttctgtaaaaacaggaagccaaaagtatataaacttgaattatttatgttcagtaattaatgttttagtattgtatcttatttataaatggtctagatatttaatgcaaatcttttacttagcttaagtttaaggttaaaaattagcaaaagtactttggaaactactattaggcagatttactgtgaacaaattatttttgaaataatgtttttcgcttttcacaagacggcaccgaaagcgaaggaagctcctgctcctcctaaagccgaagccaaagtgaaggctttaaaggccaagaaggcagtgttgaaaggtgtccgcagccacacgcaaaaaagaagatccgcatgtcactcaccttcaggcggcccaagacactgcgactccggaggcagcccagatatcctcggaagagcacccccaggagaaacaagcttggccactatgctatcaagtttccgctgaccactgagtgggccggaagaagatagaagaaaacaacatgcttgtgttcttcgtggatgttaaagccaacaagcaccagatcaaacaggctgtgaagaagctctatgacagtgatgtggccaaggtcaccaccctgatttttcctgataaagagaacaaggcatatgttcgactggctcctgattatgaagctttggatgttgcaacaaaattgggatcgtctaaactgagtccagctggctgactctaaatacatgtgtatcttttcaccataaaagaataatgtttttcataagagtgacaacttaattagaatcaaatctataagctttaagattttacatttctgtaagtataatattagcttatttgactagaactcaagcagaataggaatttatgtttgttttatattcaa

SEQ ID NO: 15145 - DNA, 624 bp, Homo sapiens
gaacttctgagctccagtgatcctcccaactcagcctcctgagtcgctaggaccacaggctatcatttgctttctgtcaggaaatacacagggcagatcacatcacttttcattggaatgctcatctgcaggcacttgatgttgtgtatcagtgttttctgtctgctgatgactctcctgttccccttcgttcttgtagttttgtatattttactcaccttcagatcatcttggcagtattgctttctccacttcatttgggatctttccttatttctaattgatcatgtttgccactgttgacagtggcagatccgcatgcgttatttatttcaagaaccctatcccacttctctgcatgcctgcatatattagcctcataaatcaccaagaaaataaagatcttaatgtactctttcaactagctgttgttcagcaagacaccctaaggagagtgaaaactaaagaacaaactggggtaagatatttgttaaaataatatataacttcatataattgtaaaaagattaatatctagactatatattttttaaaaaccctgtgactcaagttataaaaagacaacccggtagaaaagtgaataaaggacttaagcatttcata

SEQ ID NO: 15146 - DNA, 624 bp, Homo sapiens; identical to SEQ ID NO: 15145

SEQ ID NO: 15147 - DNA, 4243 bp, Homo sapiens; identical to SEQ ID NO: 6513

SEQ ID NO: 15148 - DNA, 3461 bp, Homo sapiens; identical to SEQ ID NO: 6514

SEQ ID NO: 15149 - DNA, 344 bp, Homo sapiens; identical to SEQ ID NO: 6515

SEQ ID NO: 15150 - DNA, 195 bp, Homo sapiens; identical to SEQ ID NO: 6516

SEQ ID NO: 15151 - DNA, 1464 bp, Homo sapiens
ggcttccatatcagaagccttgacttaggagtcagacctgggttcaaagcctagtttcatcatttcttagctatgtgactatggggtgtttacttaacctctctgagatttctttccttgatttataatgtggcatgagcaatacctgccttgcagtgttgcatgtggtgatgtgtcttgcttggagcttcctgtggagtttgctccttcatgggttcattcactcctttttttcattcatttcttcatgtgctgttacatgtacctaggaacatatagcttagtagcttagcagcttagcactaggcgctgggcacaaaagggtggagagggtgtgtgcttagccttttgtggctggtaactctgggcccagagttgaggggaatgatttgactggcgaggcagactctgcttggtcccattgtaaaccagtcatagaagagatgcctgtcctgggtagggccctctcttccttcctggtagtgttctgagcattgtctggatgacaggcctattgagcagtagcctgtggacttgggagggaaactagggctggagagcagctctgggaggcattggggagggcgtaggtgcgatgagtcaccatcctccctcaaggacgtcttgggcaagttgtctggccccattagccagcaaccagggaaatgtagctgcaggaaaatcacctcgtttcctcgggatgttttttcttaggctggtttcctttacaagctgcaattatgttccatcccacgcaagttcagtaagtggcacttttcagagaaactgtcttggtgatcatttgggctgctgtgggccagggagttgaggagagaagggagtgagagcttctactgagtttagttggttttgtgtccatgagccatttacaaactttgcacctgattgggctcagttgcagtttcttgtatttccctaccagccaagctgttgaagctgctgagcccggaatgatgttatcactgaggcagatgacaaaccctctagttgctagaaaccaaactgctccccgagctggtgtttccgttttttgtactgactgcttatttgggcttgatatataatggtgaaaacaggaactgtttattttaggtgataagaaaccaacattatgacaagaagatgtcatcttagttactctgttaccagtaccataggccagatactatctagatgcttataaacatcttatctaatccttgtaataataagccccaagctaggttttatatccccattttatggatgggggaactgaggccaataacttcatataacttatccaaggccacaaaactagtaataaacagagtgaaattcaacccaaaaacaaactacaaatccaaatttctttacctctatgctgtctgtacttgctgttactagcaaagttctcttggtgggagttaccccatcccctctccaaaaaaaaaaaaaaaaaaa

SEQ ID NO: 15152 - DNA, 194 bp, Homo sapiens
acacggcgaaaccccgcctccactaaaaatacaaaaaattctatgggcgtggtggcgggcgcctacagtcccagcttctccggaggctgaggcaggagaatggcgtgagcccgggaggcggagcttgcagtgggcggagattgcgccactgcagtccagcctgggcgaaagagccagactccgtctcaaaaaaa

SEQ ID NO: 15153 - DNA, 435 bp, Homo sapiens
aagcattcagacctgcccagggtttgaactcctgagattaacagtctcaagttcgagcaatgggactcgggaattaaaggtccaccgaagctgtgcagtcttccctttggtatccccaaaggaagagttgcacatgggtacacttgacacccattcccacatcccacatattaaagcccagtgatgccccacctcactgtgccagtttggcaaactcccttgcgagcggggaccttttgctaagtgactgcctcagtaaatctaactcgttagtttaatgaggcagcaaacgtggcctctgtgccatcaattatgaaaagagctcctctttgagcaaaagaaaagctccaaccaaggaaaagtgtcttctgtggaaagctagtgcaaagttaggaggcctggttgccatggcaacagcctcagtggtgtgtgtgg

SEQ ID NO: 15154 - DNA, 805 bp, Homo sapiens
atggggctagccacacatatgttttacaatacttggtctgcaatgctgtcttttgggtctgagtttcttctcaggagggtatctttgggccagcaataacaatcattgttcagttatacaaactttataatttctgaagtaatttcctatacatcatttcacttagtctttacaaaaaccctatagagaaagcagggtaaagtctgaaataataaataataatcagttaatggaaatagagtatctacatcctggaaatgatggctatgttatacactatgctagctctagacattcttgtatgtggatgaaattagcttcaatacaaccatatgaacagattgggtccagaggcagagggaggcacacacagatcatttgacttgcgtgcttcagatgaggaaacacgcatagagggttaagtggcttgcagaagggcaaccactaggcaggggtagaggcagaacttgaaactacacacacccaacaaatagttcccatatgtgcctggccttggggtagggagacagatgcaagaccagtaggcccttcctccaaggagctaccagtcctgcaggagaaagacatccctcattattcaaataatacattttcaaattacaatagcaagaagtgccctagaaaagaaaagagatctggggtttcttccacttgtgtctacagccacaagccctggccccagctccctgctctctctcctctgatgcaggattatacttgcagtctcagacacccaagcaagggttattcttgggaaggggcaaccacacggcttctaatcctt

SEQ ID NO: 15155 - DNA, 852 bp, Homo sapiens
tttttttttttttaaatgaaaaactaactggggaaatacattcttggatggggctagccacacttatgttttacaatactgggtctgcaaggctgtctttggggtctgagtaccttctcaggagggtatcttggggccagcaataacaatcatggtccagttatacaaactttataatttctgaagtaattccctatacatcatttcacttagtctttacaaaaaccctatagagaaagcagggtaaagtctgaaataataaataataatcagttaatggaaatagagtatctacatcctggaaatgatggctatgttatacactatgctagctctagacattcttgtatgtggatgaaattagcttcaatacaaccatatgaacagattgggtccagaggcagagggaggcacacacagatcatttgacttgcgtgcttcagatgaggaaacacgcatagagggttaagtggcttgcagaagggcaaccactaggcaggggtagaggcagaacttgaaactacacacacccaacaaatagttcccatatgtgcctggccttggggtagggagacagatgcaagaccagtaggcccttcctccaaggagctaccagtcctgcaggagaaagacatccctcattattcaaataatacattttcaaattacaatagcaagaagtgccctagaaaagaaaagagatctggggtttcttccacttgtgtctacagccacaagccctggccccagctccctgctctctctcctctgatgcaggattatacttgcagtctcagacacccaagcaagggttattcttgggaaggggcaaccacacggcttctaatcctt

SEQ ID NO: 15156 - DNA, 530 bp, Homo sapiens
gcaccacctcagacagtctattctgtgcagaaaagccaagctttcatttgccagcccagcccacgaggggtggaagcaccaggtgaaacagcccggaacactgaaggtgacttgttggtgtgtggctagagccaggtgcttaacccctcatgctgtgaccctgcgctgccatcctcccaccccagaaatcctgctctgctgttttgtggggctcccagtgggctgataaaaggcagggcatgagaaacaggcctggggcacacccagcagtgcttgccgcacaagaggaacagggtgtttgtagccctcgttgagtttgagaactctaaaagttctcaactttgtacaacagaaaactaatgaggcgcgacaacccccactgccccaccttgccaactacaatgtgaagggaacgaccattttcccgactgtcaataatgttctgagccccgtggaagatgagctgcccacacagagccctcgagtgtcctgtgaggaagataggcaggtggtgggtcatgtggtttgtt

SEQ ID NO: 15157 - DNA, 530 bp, Homo sapiens; identical to SEQ ID NO: 15156

SEQ ID NO: 15158 - DNA, 983 bp, Homo sapiens
gattttgcaaagccacagaacaatgtgtgaccagcagaagcagccacagttccctccatcttgtgtgaaaggttcgggactaggggctgggcagggtagcaatggtgcctctgtgaaatgcccagttccatgccagacccaaactgtctgtgtgacaggccctgctccatgccctactcaaacttatgtgaagtaccaagttccatgccagactcaaacctacgtgaagtgcccagctccctgccagaggacctatgtgaaatacccaacaccctgccaaacctatgtgaagtgcccagctccctgccagacaacctatgtaaaatgcccaactccctgccaaacctacgtgaagtgcccagctccctgccagatgacctacatcaaaagtccagctccctgccagacccagacgtgctatgtccagggtgcttctccttgccagagctattatgttcaagctcctgcaagtggctcaacctcccagtactgtgtcactgacccatgctctgctccctgttccaccagctactgctgtctggctccccggaccttcggggtgagtcccctgagacgctggattcagcggccccagaactgcaacacaggatcatctggctgctgtgagaattcgggaagctctggatgctgtggttctgggggctgtggctgcagctgtggatgtggcagctctgggtgctgctgtttgggaattatccccatgaggtcccgaggtcctgcatgctgtgaccatgaggatgactgctgctgctaaacatacgacagctcaactccagaatgcactgccccgctaccccttctggaacatgcaccagcttctggccccctctctgttagtgccagtgatgtagaacctcatcactttgcctctgtgctttgcttctctaccaaggcagcctgccagagttagtacagtccccaaactttggcatgaataaagctctgaatgcatttcgtggtaa

SEQ ID NO: 15159 - DNA, 3587 bp, Homo sapiens
ggggaatcctgtgcatacaccagagtgctcacttttggtggatagttctcttctttctgatattctgccctgcaaattctagctaccttggcttccctgacctctgaattcttgtctgctcaactcaaggagaccgcaagtgactgtatgggttcttatccctacacgctggcctggaaaccctctgtagctggggcaaatatagacttcactttctttgtatcctttatctcaggaatccctgtcctgtgctgtttgctgtccagtgtccaagaactgttgtttcatatattttgtctggttttatttaaggaaggaggataaatgtggcctctgtaattccctgtgacctgaagcagctgataagtcccatattttataacaaaagactgacttcttagatgtcctttctcatataatttatactctctatatataacaattgaattgtaactcataaaattatagcagtgtcagatgtgtccatcaattaagttccataatacataagaataaaatggaaagtacattgtgaacttcgatagacatgttcacagaataacttgttattacttggtttaaaagtgcaatcctagttcatttgtttatatattttctaaaagtttttatagatctctgaattaaaatacttgtgatgatatttctgcttttatctgtattttatgttccaaaacttcacaaattatactgttaactaggtttgtataccataaagacaaatgttgaataaatagctgttctttcaatttctttaaaaaaaagatccaagatgggcattatattcattgtatgtttacaaattcttacattttagttattcttcagcaaaaaatccagatggatgtttttttcagaaagtgttgaatgggtttacaaagtttttttgtaaggaacaatattgcaaattactaaaattgtatttttataggctgtttgctcttttgtggatattgtgcctgtcaggattcttgaaggtaagttatgttataatggttaatttgaaatataattctggctgtgtcaatataaataacctcaaaaagctataagagatactcttatgataggacacttagttataattatccagaacatttgtatatagaatgattatagaattatccctttagaaaatcagggtcttgtgttggtccttattattgactgaaaaaaagatgaatgaataaatgaattaaattacatagaaagaggcccttgcttacaactgccaagctccagtggcacatttaattgtgaaaaacgaaatatatttttaaataatttatatgtggaatgctgtttttcaaagtgggtaatttagtttaatggaatataaccactcattcatccttccatccaacagaggcaagtttggacttgccttgcctttttctgcttttaacatttgtattcaaagttgtacaccattgtcaaatgtataatgtagcagtaaatcattagaggaagtaagttaagtcctgttaatactgttctcaaatataaacatatttctttaatctcttccctatagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatgctaatgtggttagaggacaccaaagatactgggtcatcagccattaagtatatctatttcaaaattaaaatatttgggaagtattgtcttatggtttcatttgtgttggtccacacagcatgttaggtcagtgtaccagtaaccaatgaaattttgtcaaattccctcactgtactagtttgttaggctgccataacaaagttctacagcttgggtggcttcaacaagaaatttgttttcccacagttctggaggctaaaagtccaagatcaaggtgttagcagggttggtttcctttgaggcctttctctttgatttgtagatggccatcttctccctgtgtctttaaatggccttccctctgtacttgtctgtgcccaaatttcttcttcttatgaggacaccagtcatactggattagggcccacactgaggacctcatttttccttaattatctctttcaaaacctatctccaaatacagtcacattctgaagtgctgggattaggatttcttcatgtgaattttggggggactacaactcagcccataacaccccctaagtatttcccagctattaagttgaaataaacttgtagtatcaatttaagcttgcatgatttgtagatgtaaatttgactttattatcattaactgttgaattatcaagtgtatgatgcagtgcaatcaagtttaacagcatggtgggtaagagcatctagattagaatcattgcagtccaaccaggtgcttaagtgacatttggcgaattatttatccttccttaggtcttctgcctcatcttcataatgggaataatgatgtctagcttattgggctgttataaggattaaatgagatagataaataaactaaactaagtgctt

SEQ ID NO: 15160 - DNA, 650 bp, Homo sapiens
ttattcctctgtatatgtttcctccacacatacagagctacttttaccattttttctttatcactggtttgcagtaatttgattaaaatattccttggtgtggttccctccccctccacttttcttctgtttcttggatctgacaatgtaaagttttcctcaaatttggaaaaaaaaattgtttaagagatggggtcttgctgtgttgcctaggctggactcgaactcctgggttcaagtgatccctccacctcctgagtagctgggattacaggcacacaccactgtgcacagctcaaatctgggaaatttttggccattatttcttcaaacatttatctgtctccccttctttctcctttgcttgagactccagttacatctgtgtgagacttctagatgttgtcccctaattcactgttctgttttttttgtttgtttgtttttctttgtctttttctctctgcgattcattttggttagtttctattgctgttttcaaatttagtaatcttcttcagtgtctaatctgctattaattccaatcagaatatttgtgtttcatatattgtatttttaatcaattaaagttcagttcaatttgtgtcttttgaaaaaaaatagtatcttccatttctctcctcctcatg

SEQ ID NO: 15161 - DNA, 12509 bp, Homo sapiens
ggagttagcgacagggagggatgcgcgcctgggtgtagttgtgggggaggaagtggctagctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcacccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtggtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggcttttggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtatacctttttgtacccataagttagctctcacttataagtgagaacacacagtatttggttttccattcctgagttgcttcacttagaataatatcctccagctccatccaaaattgctgcaaaaaaaaaaaaaaccacaaacattattttgttcttttttattgctaagtcatattccatggtgtagagataccacattttatttatccactcactggttgatgggttggttccacatctttgcaattgtgacttgtactgccatcaagtgtctttctggtataatgacttcttttcctttgggtagatacccaggagtgggattgctagatcaaatggttcttaacattttctctctggatctatttctggaaattttaggctccagtttttgttgttgttgttaataaaatgcaatggaatgtaatgatcatcacttttcattatgctttaaaatctggtaaatggaggctagaacactcctgtaaggcaagaatattctctctgttggaactcaaatacacagaactgggtaaatctcaatcttaatctttgattcaggacacaacatggctctcttttacttgctttctttaattgttttttaataatgtggtaagcatttctgaatctcctatccaatacaaaaactaggacaatacagacagtaactcctatggttacaatgaacactcctctccacttaaattaattatttacactgatgaaattgaaatagcaaaattttaatgactaaatactgtctttgattttttgttccaggtctgtcaatattaacttcttataattttctttttttttctttatgtgtgtgtgtgtgtgtatatatatatatatttaatttcaatggcttttggggtacaaatggcttttggtcatatatatgagttctacagtagtgaagtctgagattttactacaccttccacttatgtggtcccacaccacccgcctcccctgccgcctcctgccaccccctaggccaaggtaataatcatcctgaatcctgggtttatctctcacttgctttcttttcatataattttgcaaaagaatctgatctaaatgtgtttttcagagtatatatttatattttagctgttcttagagaaaatttattattttgcatgtaatcttatggaacattctcatttaataccatggtaagattcagcccttgcccaggggatagttcatttagtttgtttactggatagagctcatcatgtgactatacctcagttagtttatcagttctcccatccatggtgactaggttgcctctcagcctctcaacaacactgtttctcagtgtccttgtagaagtgatatgtgggtgttttctccttacacagagttgaaaggtgacgacaacaacgttggcactaccaatcccccaccctccagaggggtaaccagtgttaccagtttgctgtgtttcctgctacacctcgccttattcacttccatttgtatctgaaaaacgtgttgcatggtttcttttctatagaagtggtaaaatgctattgtgtcctgtacattattgattactttttttcatttaacagtagggagatgcctgggagtacacagagaactgccctcattgttttcaacttctgcactgtatgtctgtgagtttagccattctgctgttaatggaaatttacagtattctaatcttttgatattacaaacagttctgtgcgatcatcgtcatacacaaccccttgtgcacaatgcatgagtgtttctcagggtaggtaccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggaccccta

SEQ ID NO: 15162 - DNA, 10226 bp, Homo sapiens
ggagttagcgacagggagggatgcgcgcctgggtgtagttgtgggggaggaagtggctagctcagggcttcaggggacagacagggagagatgactgagttagatgagactagggggcgggctgggggtgcgagaaggaagcttggcaaggagactaggtctagggggaccacagtggggcaggctgcatggaaaatatccgcagggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattagctggtcatctggtaagcccgggacagtaagccgagtggctgttggagtcggtattgttggtaatggtggaggaagagaggccttcccgctgaggctggggtggggcggatcggtgttgcttgcctgcagagagggtggggagtgaatgtgcaccccttgggtgggcctgcagccatccagctgaaagttacaaaaatgcttcatggaccgtggtttgttactatagtgttcctcatggcgagcagatggaaccgggagacatggagtccctggccagtgtgagtcctagcattgcaggaggggagaccctggaggagagagcccgcctcaattgatgcctgcagattgaatttccagaggcttaggaggaggaagttctccaatgttctgtttccaggccttgctcaggaagccctgtattcaggaggctaccatttaaagtttgcagatgagcttatggggggcaatcttaaaaagtccacagcagatgcatccggctcgaggggccatcagctttgaataaatgcttgttccagagcccatgaatgccagcaggcacccctcctttcctggggtaaaggttttcagatgctgcatcttctaaattgagcctccggtcatactagttttgtgcttggaaccttgcttcaagaagatccctaagctgtagaacattttaacgttgatgccacaacgcagattgatgccttgtagatggagcttgcagatggagccccgtgacctctcacctacccacctgtttgcctgccttcttgtgcgtttctcggagaagttcttagcctgatgaaataacttggggcgttgaagagctgtttaattttaaatgccttagactggggatatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagcaactttaaatgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtcgtgtgtgtgtgtgtgcgtgtgtgtgtgtgtgtgtgtgtgtatgattttctaattcctagtcatttttctattgattgttttgcaaaagccatttacatcttaaggatattgataatcttttgttatatttgatgcaaatatttttttccagtttataggttgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaacctccccaagcctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagtgggtgtgaggtgacatttcattgtggttttgatttgcatttccctaatgaggagtgatgctgagcatcttttcatatgcttactggtcatttgtatgttgtctttggaaaaatgtctattcaagtcctttgactattttaaaaattgggttattagagttatcgttgttgttgacttgtaggagtttctttctatattctggatattaatcccctatcagatatatgatttgcaaatatcttctcttattccataaggttactttttcactttgttgattgtgttctttgatgtatagaagtttttagttttgaaatagtctaatttatctgtttttacttttgtggtctgtgcttttggtgtcatatccaagaaatccttgccaaatccaacgttataaggtacttttaaggtattttagttgtcttagtctatatttctgtactcacctttctttatccactcatcagttgatgggcatgtaggttggttccatatctttgcaattctgaattgtgctgtgatcaggtgtctttttagtataatgatttactctcctttgggtagatacccagtagtgggattgctggatcgaatggtttttataattttctattttaccacagtttctctctgcatttttcctctttgaccactaaccatgtgaaattctcatattgacctttataatgatcatgaactcttagtatcattgggaaggccacatttgccacttatgattgtaaaccttatcctccatttttcctgttattgttggtgcaaaaagcacctattataccaggactttaaaaatcagtctgataagtctttgataagtctaataataataactgataagtccattgaatttgcttctgattactttttctttagtagctaaacatgtatgtactcctatgattacaatgaacactcctctccatttaaattaattatttacattgatgaaatagcaaaatgttaatgactaaatactgtcttggttttttcgttccaggtcagtcaatattaacttcttataattttcttttttttctttatgtgtgtgtgtgtgtgtatttttttttttttaatttcaatggctttgggggtacaaatggcttttggtcatatagatgaattctacagtagtgaagtctgagattttactgcaccggtcacctgagtagtgtacattgtacccaatatgtggttttttataccttgcccccctcttaccctccccactttgagtctctagtgtccattatgtcactctgtataccttttggtacccatcagttagctctcacttataagtgagaaccaccactgtatttggttttccattcctgagtggcttcacttagaataatatcctccagctccatccaaaattgctgcaacaaaaa

SEQ ID NO: 15163 - DNA, 701 bp, Homo sapiens
gcacagggaggggtgcatgtcaggcccagccctgcctgctgataccacctcacagacgcaggcgaaatgtcttcaccagcttcttctcggttgccaagggggcctgctttcaaggggttgttttgtatggggtgtgggtgttaaccagggagaggttcctggcaggagttcctgtcagatgccattttccattctggttacttgaaccggggtcctttttcatcctctacctcaggggccagagcttcctcatcaccctgcaccccctagcaagggaggtgcccgctacacggtccaaagtcctctccagacattcgggccctgcccgccttgctggagggctcaggagttcaccaggtttgcttccagaagagccaggctggggatgcctgcttgcaaatgcagcaaataaaaaataaataaataaataaaaatcacctttctccccacccccacccaaatgtaaaatgagccgacagcctgtccctcggctatgtcagatactgctttccgcacaatatcttggttttacattattttgcaacggcctcttcccacttaatccatcctgaacacacttcttgaatgttctaccccggcagggatgcgcattctcaggaaacacgtcccctcgccaggcccctgggaagagtcaaaaccacgatgcctgcccctgaagcgcccgcgcggctccacggggc

SEQ ID NO: 15164 - DNA, 1608 bp, Homo sapiens; identical to SEQ ID NO: 13968

SEQ ID NO: 15165 - DNA, 701 bp, Homo sapiens; identical to SEQ ID NO: 15163

SEQ ID NO: 15166 - DNA, 14717 bp, Homo sapiens
cgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgaggtgagagtccccctgccgagccgcgggatccagggcctgctgtgctgggcgcagccggccgggggctgcgggccccgagcccctttcgaccctggggccgcgtctctggagcgaagtttctctctgcagcttcttcgggggcccgctctgagctcagggcctggcactggctccaaggtacctagagtcatacaggcagagagttggccagaagttagttatatttggatttctcatcctgcattttctcaacccctcactcccatccaagctgggagagaaatgacgaaggcggccttttgctacctccaggcctcgcgggttgtaggtcatgggtgcccctgcttctcctgtcgagacagttcttgggagattctcgtcgacccaggaatcggccgctttccttgccccttctgcaggagcggggcttgattcttagccagaataggaaggaatcttcgaagagaatgggccaggaaagtttgattgtagcctcctcccccgccctcttttcgagcgaagaatatgtgtgcttaaaagtagaatcggcaggccgcccccagagggtggttctatcgaagccatcctgcacgtgaggctggtggctgtgtgtgaactgggtcaaccagtgtaagaatccgaatggtctatcagagaatgcttacaacctcccctaggtgatcctgagagttctaattccagcttagggggaaaatgattgtgacttaacttgctgggcaacagtggtttttaacggagctgctcccttcccaaagttagtgtgtgtcagaattgccagggcagctggttaaaaatgcagattcctagtccccactcgaaattgattatagtagattgagcttttttgctgggatccaggtttctgcaccaggggcttgtgatgtaggttgccccgagaccaccgttttggaagatcagctttataatctttgtttcttctgttggagggattggaaaacaggtttcagaaggaagttctttgctaggagattgatactgtatgctgggttcagaggctaccaaattggcagtatgccacctccagacaaccaggagacagactcactcttcactttctctcattctttttctgcgatgcccagatttggctcttgcttttactaaaatagttagttcttcccaagtcgattgcagtgtcctggagtttgttatattaaggagtttattgcctttcacacatgtgagggtcttgggacacagggctgttttgtgaagttctatgtttgtcttggagtttgttgagccctggcatgtagatcacagtagcctgggttcagctgactcagggctccagtctttagcagcggtaacagcagccaaagccagactttatagcaggaggtcattactatctctatcctggacccttcctctttcttcacgagtgtgggcagggaggaaagagcccttgaggaaactagacagtttgtggactttgcctcttgagatagcggtggtgagggtgctgagcggatggtttctttcacttagcagataccaggccttacattggttacatcgtcctattcagtctgttgtgcagagaataaagccgagtaagaccacacaggtttagttcccagatactgcccttattcagaaattctggttttaatttgctgatgcaggtggtgtgtgtgtgtgtgtgtgtgtgtgtgtgtttctttggcttggtcagcagtcagccaagatctgtgtccttgggttattggctcatggttgcagttccttggaaggagtttattgtagcaggtaaaattacatgagacctaccaaagcttgtgtgtactggagtcctatttcggacactggcccttggggcattgtataaatgaaggttccctgctaaggttcccctctccattctaccaatctgggtaagaattggagcagtattaaggcatggatggggagtgggaggtggcgcttgtcagctgcagtttggaccagcttgttgcaacattgcgcttaccaggttcctgagaaaggcattttgctggctttaggtcgggctgagatgcgcataagcttgcactctcaggaggcagctctctactaaggagtcagtcctaccaagggaagtccagctgttcacactgcctttcttctgggcctgtttggataagggtgtgccaggtatttgaagacccttgcctcgtgcagctatttacactgattgcagtaggaactgtatgccttatttcttttcccgcctgcctgtgatattgtttccagcatgctgagaaaagttgattttatgttgaatgaattcaggtatttgttaccaagttagtccagataagggtttggccttcttttgaacttgctgtttctgtgtagtttctttgtagttcaacattcttgtaattgtgagtggcccagggcacctagtggtttatgctttcaaaagcagttcagaatatttattgaatttcatttctgccttgaggatagctagtgcttacagcctgggaaaggctttttcagcctgtgtgcttccacagatgggagcaccactacagaaagtggtttagaagcgttcaccttggggttttggtatgaggcacattccagggtttttatttatttattgaaaatttttaattttttttttattgtagacacaggggtctcactatgttgcccaggctggtcttgaacttctgtcctcaagtgatcttcccaccttggcctcccaaactgctgggattacaggcatgaaccatcacgcctgaccatgttccagatttgtaacttggtcattttgagttcctcttcactctgactaggaaaagacctggttatttgacctgagggcacagaattttgcttgagtttagggaaggctatttcctcttcagagaaagatacctgctaaagtcgcaggtcctcgagaaacttgctttacgtctctgagccttgttttccttttcaaaaaatctctcatgctttagaaatttctgataagactgtaaactctcctgtccagagtagcttgaagtgtctctgtcactttttttttccttgatgaccttttacatggaattaaaaatagggcagaacatagctccagaggggaaaaaagttggttggggaccagagcctatcaggttgctaatgctgtaaccttaaggaataccctttcctgggctgccttcctttcacctggggaaggatttggctttggggaggtaagagcttgaaacatgggatgagagaggagtcactgctacctctgatttgctcaaagccatggcagttgtttagaattctctacctctactgtcacctaacaggcaggcttcatctgcaggccttccaaatagtggaagttcacaggtagaaaatttaggtccctgaatccgtgggttcgctgtctcagcccattcagaacaattctttaggtactggcctcactggagaaagaagtgatccagaagaacagtctagtgaccaggagatctgagggtagggtgggagtgacgctagagcaccaaggggggctttacagctgtgttctcatggaggacaggcttctgctcattctggctttcccactcttgtggttcccagttgcagttttccagttagttttattacttccttttcttttgatccattccctaaactgccttgagtggaggcatttgtttagtgcttatcgtgtgcatatccttgcctggctagcatacccatgtttctgtgtctctctccgtgtgaggcattgtattgagctatttatacagattgttttatccttaccacaatgctgtgggataggtggtgtccccattttataggtgagaaaacagacctagagaaaacaacttgttcagtgacacttcgtgtatgtcttttcctgaaccctgtgctgaattttccaaggagcctagttactacattgtctaaaactaagaaagagcagacataatgtaggcccttcggcccccttcctttttggttaactgagttatgccaatttcagcagtatgctgactgtacacttcattgtattttagagaaatctgtttcgctgtgaatgcataaaggctaaggagggaggaacaacccttgtttgctgctgcatctcttgggacttgggcaaattcaactttgcacgtggcagatctcttgggaaagccacttgggttttaaagggaaatattttaaaggtaattccaaggttgttaagtaatttttgttcacatggttgagttttcttcactgtgggactgagactgccgcagattacgttactgtcagttcctcactttttccacttggcaagaaaaaaaaaaagattcggcctggtgtggtggctcacgcctataatcctagcactttgggaggccgatgcgggcagatcacctgaggttggagttggagaccagcttggctaacatagtgaaagcccgtttctactaaaaatacaaaaaattagccgggcgtggtgatgcgtgcctgtaatcccagctacttgggaggctgaggcaggagaatcgcttgaccctgggaggtggaggttgcagtgagctgagattgcgccattgcactccagcttgggcaacaagagcgaaactccgtctccaaaaaacaaaaacaaaaacaaaaaaacaattccccacccatgcacaaaattttctgtgtatccgtaaatcaaatgtagtcgatgttccagatttgtaatgatcacagtcctcatggaagaaggaaattcttagagctcagttggaagagaaacagcagtctttcagtcttcataggtttgtatcccggggcaatggttttttgaggctggaaaggagggggagcatgttagcagtacatcctttgtatgcattgctcagctactctttgatttcttgaggagaaatagaaagaaaaaagtctgaagacaaaagtgcaatgagtttcctcttccattgtctcatcagtccctctgatctcgtggctaatgtcacttacaggaactgttaacagttatgtttatttttttgaggtcttgacctcaaccactgggtctttttgttaatcttttaccttttgccatgtcttctcccttgttgatgattcagaagataaagctctggggatgacagcccctggccttctcccaaaggatctagttgccagatgtcttcagggtcaccacgtgagattggaaggcagtcttgaaatcttaatttcatgcgggaggagagactacatgacggctacatctgtagttggaacagtatatttatggagcactggaaagccttactgtgtttataggataaaggagtcaggctactctctggaggaagcagaactatttacctctgagactgaaatgtgatatcttatatttgcacaaaaaagattcggcctggcgcggtggctcacgcctgtaatcctagcactttgggaggccgatgcgggtggatcacctgcggtcaggagtttagtgtgttgtgcgagaggaagaaaaaaacatatatacaactgtcttacaccaaggttgggagagggccagggccaagagaggttttctgctcttctgatactgacccgaggtaagtaactttttacttttatcctctctcattccttgtcagtttgtgaaatgtgaaaggtgattcccctaggacttggacatcttaggcagattgccttgccctgcaggatgctccagccttgtggacagagtggcatggcttcactgctttgcaggcacctccttcattgtcatttattcattcagcaaactgtatgagtggcgactatgtgccaggtcccgtgctaggcactggaggtgcagtggtgactttttttttctgctgttggtttatctgagtgaatgttcaagtaagtaggtgaggtggagttttgtgagtctgtgggaaggaaggaaattagcatcacacctttcttttatgagcctgtttttgtttacagctttggaactttttgaatgaaaattataaaaaaaacacacaacaactaaagctggaattttattcgtaaggacaatgaagaatgactttccaaagcagatatcctgtttgttttagactctgggcttttctgaatgagagaaaacattctttgaacttcatcttgtatggagttcctggccatcccccttgttttaggaggtttctctgaagccctccctcttggggaaccaggcagctgcaacacagcactttcttctggtaatgagttagacttgttctccgtacagtcagggggaaaaagtcattttaatgtgcttttagaaagttccgctctgaggtttacaggggctgttggcctgattagtgtttagtttctttcattttactcttccatagtaatggctgtatgattcctgcctttgttggagctctgtttggagccaggtgcagagtgggtggccccttttatggagagggttattagcattgccctggaaatgcctctggctgttctggggtctttgcttttcttttgtgtcttgcctctgatgtgctttctctttgtcttttgtcctcagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtgaggcctagtcaggctgctgcttgaccagtaggacattgctgctcttggacaatccacgattatggggctagagagtgtgagagtctctccagaaaggcagaacagatgagctctagagaagcatgttccatagtgcacaaggctgcacttgccttgggggtgagtgacagaaagcaatgccagaatccttgttttgccaactaactgatcctgttaaggccctcctggctacttccctccatggtttgccgcaccttcttgtttttagccttatttttcctctgtcccttcctgtgaatttccttcttcctatgctaagctttttgtttgtattctttgttccttaaagccaatataagaactcctgggcagtgaaggaacacggctttgatttgacccgggttaaggatgctaaccaccctggatatccagacccatcatttcttaaattatttttgaacttcaagcccaaacacgtgcatgatgtccaactgcttgaaaggatgtaaagctgatggttttgacattgttttcttttcttatcctggaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggtaattcccctattctgcccattgctgaagagagtgggtacaggggaagttgtttgctgctgtgtggggttgaccactgtttcccttttcctaggggtactatgacaatcccaaggtctgtgcactctacatcatggctgggacagtggatggtaggttgtgttctgacctgcttttttgacttgagtggagggatatggttgaggaagcccttgggaggtaattgagctgatcactattttggaaacacttaaagctaaattgtaggggattcagaatcagttggataaggatgaagcataacatggtactagccacaagctttggagtcaggtctatgtatatcttgttgctgccatttaatcagatgtttgtcttggatggatgcttttaatttccctataaattgggattaataatggtacctattggtgtaccctgacctttgtagtcatttgggatcacctaaaacttgtccttattctgtttgtttgacatctctttcctaggggaaaaaaaggtaaaaggaggagtcctgtaggcttttggtatgctctgaaagattccagcattgctggactgcactgggacaaaacttcacttatttatgtctccttatccttgggatcaagtcttagagtatatttctttctcagggtttagattctcctggctgccagcatctcaggctgatttttgcagagaaagctgcgtctttgtgacatttctcccccattccacctctgtacctttccccaactcaatcttgaatgcactgaggatttcatcctgttgtcttgatgtcccccaaatgctgatattatgacatctaggaggatgaatgtcttaccaccaaacagacctgtgttcaagtccctgaggaggaggcaggacagagggatagtgtgtgctgggaacccagaactctctgggtcaacgtttcttcagttgttgtgtgaatcaaaagggaatgtgggcttgtgggaggaggagggatttgaaaaggctaaagtttaggcattggatcattgtccctgtccagtctggttatcttggggctctgtaaaagtagaacaggaaggtaagatagtgaacctccctatgagcacggctttttctactttctagttaaatctaaagcttttgcagcactctgctgttctgtagaccagaggctatttctgctacttctggtcttttctctggacccgggttcaatcacagcaatctctttattgtggcttatttgctgcttttaagggtctctcttacttaaatgctgtgggtcttaacagtgttttcttccttgtgttagatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctcctcctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgacactctg

SEQ ID NO: 15167 - DNA, 7871 bp, Homo sapiens
tagcattgccctggaaatgcctctggctgttctggggtctttgcttttcttttgtgtcttgcctctgatgtgctttctctttgtcttttgtcctcagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtgaggcctagtcaggctgctgcttgaccagtaggacattgctgctcttggacaatccacgattatggggctagagagtgtgagagtctctccagaaaggcagaacagatgagctctagagaagcatgttccatagtgcacaaggctgcacttgccttgggggtgagtgacagaaagcaatgccagaatccttgttttgccaactaactgatcctgttaaggccctcctggctacttccctccatggtttgccgcaccttcttgtttttagccttatttttcctctgtcccttcctgtgaatttccttcttcctatgctaagctttttgtttgtattctttgttccttaaagccaatataagaactcctgggcagtgaaggaacacggctttgatttgacccgggttaaggatgctaaccaccctggatatccagacccatcatttcttaaattatttttgaacttcaagcccaaacacgtgcatgatgtccaactgcttgaaaggatgtaaagctgatggttttgacattgttttcttttcttatcctggaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggtaattcccctattctgcccattgctgaagagagtgggtacaggggaagttgtttgctgctgtgtggggttgaccactgtttcccttttcctaggggtactatgacaatcccaaggtctgtgcactctacatcatggctgggacagtggatggtaggttgtgttctgacctgcttttttgacttgagtggagggatatggttgaggaagcccttgggaggtaattgagctgatcactattttggaaacacttaaagctaaattgtaggggattcagaatcagttggataaggatgaagcataacatggtactagccacaagctttggagtcaggtctatgtatatcttgttgctgccatttaatcagatgtttgtcttggatggatgcttttaatttccctataaattgggattaataatggtacctattggtgtaccctgacctttgtagtcatttgggatcacctaaaacttgtccttattctgtttgtttgacatctctttcctaggggaaaaaaaggtaaaaggaggagtcctgtaggcttttggtatgctctgaaagattccagcattgctggactgcactgggacaaaacttcacttatttatgtctccttatccttgggatcaagtcttagagtatatttctttctcagggtttagattctcctggctgccagcatctcaggctgatttttgcagagaaagctgcgtctttgtgacatttctcccccattccacctctgtacctttccccaactcaatcttgaatgcactgaggatttcatcctgttgtcttgatgtcccccaaatgctgatattatgacatctaggaggatgaatgtcttaccaccaaacagacctgtgttcaagtccctgaggaggaggcaggacagagggatagtgtgtgctgggaacccagaactctctgggtcaacgtttcttcagttgttgtgtgaatcaaaagggaatgtgggcttgtgggaggaggagggatttgaaaaggctaaagtttaggcattggatcattgtccctgtccagtctggttatcttggggctctgtaaaagtagaacaggaaggtaagatagtgaacctccctatgagcacggctttttctactttctagttaaatctaaagcttttgcagcactctgctgttctgtagaccagaggctatttctgctacttctggtcttttctctggacccgggttcaatcacagcaatctctttattgtggcttatttgctgcttttaagggtctctcttacttaaatgctgtgggtcttaacagtgttttcttccttgtgttagatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgacactctg

SEQ ID NO: 15168 - DNA, 2775 bp, Homo sapiens
  misc_feature (40)..(40): n equals a,t,g, or c
  misc_feature (76)..(76): n equals a,t,g, or c
  misc_feature (1036)..(1036): n equals a,t,g, or c
ggaaacaggaagaagtatggtgggggctggggtagactcncctgaagccaagcctatccagctaacaagagctccntggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagctgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaacggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctcccccttctgtgcctgggaactgtttggtccagcttagaactgtggttttgacttcctatctcttgggagaagcttctgttttaaggaatttctcttccttcttctcntgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacacggaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtagg

SEQ ID NO: 15169 - DNA, 14719 bp, Homo sapiens
cgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgaggtgagagtccccctgccgagccgcgggatccagggcctgctgtgctgggcgcagccggccgggggctgcgggccccgagcccctttcgaccctggggccgcgtctctggagcgaagtttctctctgcagcttcttcgggggcccgctctgagctcagggcctggcactggctccaaggtacctagagtcatacaggcagagagttggccagaagttagttatatttggatttctcatcctgcattttctcaacccctcactcccatccaagctgggagagaaatgacgaaggcggccttttgctacctccaggcctcgcgggttgtaggtcatgggtgcccctgcttctcctgtcgagacagttcttgggagattctcgtcgacccaggaatcggccgctttccttgccccttctgcaggagcggggcttgattcttagccagaataggaaggaatcttcgaagagaatgggccaggaaagtttgattgtagcctcctcccccgccctcttttcgagcgaagaatatgtgtgcttaaaagtagaatcggcaggccgcccccagagggtggttctatcgaagccatcctgcacgtgaggctggtggctgtgtgtgaactgggtcaaccagtgtaagaatccgaatggtctatcagagaatgcttacaacctcccctaggtgatcctgagagttctaattccagcttagggggaaaatgattgtgacttaacttgctgggcaacagtggtttttaacggagctgctcccttcccaaagttagtgtgtgtcagaattgccagggcagctggttaaaaatgcagattcctagtccccactcgaaattgattatagtagattgagcttttttgctgggatccaggtttctgcaccaggggcttgtgatgtaggttgccccgagaccaccgttttggaagatcagctttataatctttgtttcttctgttggagggattggaaaacaggtttcagaaggaagttctttgctaggagattgatactgtatgctgggttcagaggctaccaaattggcagtatgccacctccagacaaccaggagacagactcactcttcactttctctcattctttttctgcgatgcccagatttggctcttgcttttactaaaatagttagttcttcccaagtcgattgcagtgtcctggagtttgttatattaaggagtttattgcctttcacacatgtgagggtcttgggacacagggctgttttgtgaagttctatgtttgtcttggagtttgttgagccctggcatgtagatcacagtagcctgggttcagctgactcagggctccagtctttagcagcggtaacagcagccaaagccagactttatagcaggaggtcattactatctctatcctggacccttcctctttcttcacgagtgtgggcagggaggaaagagcccttgaggaaactagacagtttgtggactttgcctcttgagatagcggtggtgagggtgctgagcggatggtttctttcacttagcagataccaggccttacattggttacatcgtcctattcagtctgttgtgcagagaataaagccgagtaagaccacacaggtttagttcccagatactgcccttattcagaaattctggttttaatttgctgatgcaggtggtgtgtgtgtgtgtgtgtgtgtgtgtgtgtgtttctttggcttggtcagcagtcagccaagatctgtgtccttgggttattggctcatggttgcagttccttggaaggagtttattgtagcaggtaaaattacatgagacctaccaaagcttgtgtgtactggagtcctatttcggacactggcccttggggcattgtataaatgaaggttccctgctaaggttcccctctccattctaccaatctgggtaagaattggagcagtattaaggcatggatggggagtgggaggtggcgcttgtcagctgcagtttggaccagcttgttgcaacattgcgcttaccaggttcctgagaaaggcattttgctggctttaggtcgggctgagatgcgcataagcttgcactctcaggaggcagctctctactaaggagtcagtcctaccaagggaagtccagctgttcacactgcctttcttctgggcctgtttggataagggtgtgccaggtatttgaagacccttgcctcgtgcagctatttacactgattgcagtaggaactgtatgccttatttcttttcccgcctgcctgtgatattgtttccagcatgctgagaaaagttgattttatgttgaatgaattcaggtatttgttaccaagttagtccagataagggtttggccttcttttgaacttgctgtttctgtgtagtttctttgtagttcaacattcttgtaattgtgagtggcccagggcacctagtggtttatgctttcaaaagcagttcagaatatttattgaatttcatttctgccttgaggatagctagtgcttacagcctgggaaaggctttttcagcctgtgtgcttccacagatgggagcaccactacagaaagtggtttagaagcgttcaccttggggttttggtatgaggcacattccagggtttttatttatttattgaaaatttttaattttttttttattgtagacacaggggtctcactatgttgcccaggctggtcttgaacttctgtcctcaagtgatcttcccaccttggcctcccaaactgctgggattacaggcatgaaccatcacgcctgaccatgttccagatttgtaacttggtcattttgagttcctcttcactctgactaggaaaagacctggttatttgacctgagggcacagaattttgcttgagtttagggaaggctatttcctcttcagagaaagatacctgctaaagtcgcaggtcctcgagaaacttgctttacgtctctgagccttgttttccttttcaaaaaatctctcatgctttagaaatttctgataagactgtaaactctcctgtccagagtagcttgaagtgtctctgtcactttttttttccttgatgaccttttacatggaattaaaaatagggcagaacatagctccagaggggaaaaaagttggttggggaccagagcctatcaggttgctaatgctgtaaccttaaggaataccctttcctgggctgccttcctttcacctggggaaggatttggctttggggaggtaagagcttgaaacatgggatgagagaggagtcactgctacctctgatttgctcaaagccatggcagttgtttagaattctctacctctactgtcacctaacaggcaggcttcatctgcaggccttccaaatagtggaagttcacaggtagaaaatttaggtccctgaatccgtgggttcgctgtctcagcccattcagaacaattctttaggtactggcctcactggagaaagaagtgatccagaagaacagtctagtgaccaggagatctgagggtagggtgggagtgacgctagagcaccaaggggggctttacagctgtgttctcatggaggacaggcttctgctcattctggctttcccactcttgtggttcccagttgcagttttccagttagttttattacttccttttcttttgatccattccctaaactgccttgagtggaggcatttgtttagtgcttatcgtgtgcatatccttgcctggctagcatacccatgtttctgtgtctctctccgtgtgaggcattgtattgagctatttatacagattgttttatccttaccacaatgctgtgggataggtggtgtccccattttataggtgagaaaacagacctagagaaaacaacttgttcagtgacacttcgtgtatgtcttttcctgaaccctgtgctgaattttccaaggagcctagttactacattgtctaaaactaagaaagagcagacataatgtaggcccttcggcccccttcctttttggttaactgagttatgccaatttcagcagtatgctgactgtacacttcattgtattttagagaaatctgtttcgctgtgaatgcataaaggctaaggagggaggaacaacccttgtttgctgctgcatctcttgggacttgggcaaattcaactttgcacgtggcagatctcttgggaaagccacttgggttttaaagggaaatattttaaaggtaattccaaggttgttaagtaatttttgttcacatggttgagttttcttcactgtgggactgagactgccgcagattacgttactgtcagttcctcactttttccacttggcaagaaaaaaaaaaagattcggcctggtgtggtggctcacgcctataatcctagcactttgggaggccgatgcgggcagatcacctgaggttggagttggagaccagcttggctaacatagtgaaagcccgtttctactaaaaatacaaaaaattagccgggcgtggtgatgcgtgcctgtaatcccagctacttgggaggctgaggcaggagaatcgcttgaccctgggaggtggaggttgcagtgagctgagattgcgccattgcactccagcttgggcaacaagagcgaaactccgtctccaaaaaacaaaaacaaaaacaaaaaaacaattccccacccatgcacaaaattttctgtgtatccgtaaatcaaatgtagtcgatgttccagatttgtaatgatcacagtcctcatggaagaaggaaattcttagagctcagttggaagagaaacagcagtctttcagtcttcataggtttgtatcccggggcaatggttttttgaggctggaaaggagggggagcatgttagcagtacatcctttgtatgcattgctcagctactctttgatttcttgaggagaaatagaaagaaaaaagtctgaagacaaaagtgcaatgagtttcctcttccattgtctcatcagtccctctgatctcgtggctaatgtcacttacaggaactgttaacagttatgtttatttttttgaggtcttgacctcaaccactgggtctttttgttaatcttttaccttttgccatgtcttctcccttgttgatgattcagaagataaagctctggggatgacagcccctggccttctcccaaaggatctagttgccagatgtcttcagggtcaccacgtgagattggaaggcagtcttgaaatcttaatttcatgcgggaggagagactacatgacggctacatctgtagttggaacagtatatttatggagcactggaaagccttactgtgtttataggataaaggagtcaggctactctctggaggaagcagaactatttacctctgagactgaaatgtgatatcttatatttgcacaaaaaagattcggcctggcgcggtggctcacgcctgtaatcctagcactttgggaggccgatgcgggtggatcacctgcggtcaggagtttagtgtgttgtgcgagaggaagaaaaaaacatatatacaactgtcttacaccaaggttgggagagggccagggccaagagaggttttctgctcttctgatactgacccgaggtaagtaactttttacttttatcctctctcattccttgtcagtttgtgaaatgtgaaaggtgattcccctaggacttggacatcttaggcagattgccttgccctgcaggatgctccagccttgtggacagagtggcatggcttcactgctttgcaggcacctccttcattgtcatttattcattcagcaaactgtatgagtggcgactatgtgccaggtcccgtgctaggcactggaggtgcagtggtgactttttttttctgctgttggtttatctgagtgaatgttcaagtaagtaggtgaggtggagttttgtgagtctgtgggaaggaaggaaattagcatcacacctttcttttatgagcctgtttttgtttacagctttggaactttttgaatgaaaattataaaaaaaacacacaacaactaaagctggaattttattcgtaaggacaatgaagaatgactttccaaagcagatatcctgtttgttttagactctgggcttttctgaatgagagaaaacattctttgaacttcatcttgtatggagttcctggccatcccccttgttttaggaggtttctctgaagccctccctcttggggaaccaggcagctgcaacacagcactttcttctggtaatgagttagacttgttctccgtacagtcagggggaaaaagtcattttaatgtgcttttagaaagttccgctctgaggtttacaggggctgttggcctgattagtgtttagtttctttcattttactcttccatagtaatggctgtatgattcctgcctttgttggagctctgtttggagccaggtgcagagtgggtggccccttttatggagagggttattagcattgccctggaaatgcctctggctgttctggggtctttgcttttcttttgtgtcttgcctctgatgtgctttctctttgtcttttgtcctcagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtgaggcctagtcaggctgctgcttgaccagtaggacattgctgctcttggacaatccacgattatggggctagagagtgtgagagtctctccagaaaggcagaacagatgagctctagagaagcatgttccatagtgcacaaggctgcacttgccttgggggtgagtgacagaaagcaatgccagaatccttggtttgccaactaactgatcctgttaaggccctcctggctacttccctccatggtttgccgcaccttcttgtttttagccttatttttcctctgtcccttcctgtgaatttccttcttcctatgctaagctttttgtttgtattctttgttccttaaagccaatataagaactcctgggcagtgaaggaacacggctttgatttgacccgggttaaggatgctaaccaccctggatatccagacccatcatttcttaaattatttttgaacttcaagcccaaacacgtgcatgatgtccaactgcttgaaaggatgtaaagctgatggttttgacattgttttcttttcttatcctggaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggtaattcccctattctgcccattgctgaagagagtgggtacaggggaagttgtttgctgctgtgtggggttgaccactgtttcccttttcctaggggtactatgacaatcccaaggtctgtgcactctacatcatggctgggacagtggatggtaggttgtgttctgacctgcttttttgacttgagtggagggatatggttgaggaagcccttgggaggtaattgagctgatcactattttggaaacacttaaagctaaattgtaggggattcagaatcagttggataaggatgaagcataacatggtactagccacaagctttggagtcaggtctatgtatatcttgttgctgccatttaatcagatgtttgtcttggatggatgcttttaatttccctataaattgggattaataatggtacctattggtgtaccctgacctttgtagtcatttgggatcacctaaaacttgtccttattctgtttgtttgacatctctttcctaggggaaaaaaaggtaaaaggaggagtcctgtaggcttttggtatgctctgaaagattccagcattgctggactgcactgggacaaaacttcacttatttatgtctccttatccttgggatcaagtcttagagtatatttctttctcagggtttagattctcctggctgccagcatctcaggctgatttttgcagagaaagctgcgtctttgtgacatttctcccccattccacctctgtacctttccccaactcaatcttgaatgcactgaggatttcatcctgttgtcttgatgtcccccaaatgctgatattatgacatctaggaggatgaatgtcttaccaccaaacagacctgtgttcaagtccctgaggaggaggcaggacagagggatagtgtgtgctgggaacccagaactctctgggtcaacgtttcttcagttgttgtgtgaatcaaaagggaatgtgggcttgtgggaggaggagggatttgaaaaggctaaagtttaggcattggatcattgtccctgtccagtctggttatcttggggctctgtaaaagtagaacaggaaggtaagatagtgaacctccctatgagcacggctttttctactttctagttaaatctaaagcttttgcagcactctgctgttctgtagaccagaggctatttctgctacttctggtcttttctctggacccgggttcaatcacagcaatctctttattgtggcttatttgctgcttttaagggtctctcttacttaaatgctgtgggtcttaacagtgttttcttccttgtgttagatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagatttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccctccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgacactctg

SEQ ID NO: 15170 - DNA, 477 bp, Homo sapiens
tacaccaaggttgggagagggccagggccaagagaggttttctgctcttctgatactgacccgaggtaagtaactttttacttttatcctctctcattccttgtcagtttgtgaaatgtgaaaggtgattcccctaggacttggacatcttaggcagattgccttgccctgcaggatgctccagccttgtggacagagtggcatggcttcactgctttgcaggcacctccttcattgtcatttattcattcagcaaactgtatgagtggcgactatgtgccaggtcccgtgctaggcactggaggtgcagtggtgactttttttttctgctgttggtttatctgagtgaatgttcaagtaagtaggtgaggtggagttttgtgagtctgtgggaaggaaggaaattagcatcacacctttcttttatgagcctgtttttgtttacagctttggaactttttgaatgaaaattataaa

SEQ ID NO: 15171 - DNA, 517 bp, Homo sapiens
atttgaagagggcttgccttccaacctataggcactatatatgcttttggaaaaagtaattaggttaagatgcagttgttttgttttgctttgtttttcccttagctgggttggggtttctagcagcaatgatgtacaggtggatcttttttcacattaacactaccagctgctccatggctatagtgcttaggaatatctcagaatttcaacagatctatcagctgcaatatctaggagtcttgccaacacagagacacattcacatgctgaaaagagcatgagttgaaggcacagctggggacttttgatgcaggtccagaactggatggttgtgaagccattagagatatttaaattgtccagaatttcaggctctgctttaaaaactaggctacaaaccctcattcagaaagaggtcagtaatatgcctgtgagttagaaagatactggaaacatttcaatgccaaaagtaacatttttttccagaatgctatgactaaattttttaaaaaaa

SEQ ID NO: 15172 - DNA, 18501 bp, Homo sapiens
  misc_feature (9479)..(9480): n equals a,t,g, or c
cccctgccttttttttttttttttttgagacggagtcttgctccgtcgcccaggttggaatgcagtggcgcgatctcggctcactgcaagctcgactcccgggttcaccccattctcctgcctcagcatcctgagtagctggagctacaggtgcccgcaaccacgcccggctaatttttttgtatttttagtagagacagggtttcaccgtgttagccaggatggtctcgatttcctgacctcgtgatccgcccacatcggcctcccaaagtgctgggattacaggcgtgagccaccgcgccctgccagcccctgctcttttcaaagcctgcttctgcagctgcttcatcaatgctatttactcccaattatctttccaatcaattcccttttgctcaaattggagtcagtttctgttgctttcaacccaaagaacagttaactgatccagctttcatcatctggcccatttccagtcttagttccctccagcatatgccataaccatagctcagtggttctcaaacctgagagtgcaaaacaatcacctagaggtcctgttaaaacaaatttctgggctccattagcagcagttcagttcccaagtgatgctacctctctggtctaggaaccactgctctagagttctctttacatctccccagcgtatacccctatttgggtagggtattcaactgtcccattttgcccaggacttaaaggtttccagggaagtaggactttcagtgctgaaaccaagccagtctagggcaaactggactgtaggaattgtagctgcaaagagccattctcttcaccacccacaggaaatagaaatgaaatgtaaacactttcattccactctcctttgtccccattaaggaaggacttggtaggcacactcagcagatgaaacattaaaaggctgcctctccttggcatagaaatcactttctgatacagagaatggacttaagcaggtatccacagagactactttatttatttacaatgccatagtttagaaaacaatcactcctgtacgtggttcttaccttaaggtcaccggaggagaacatgctgatgtaattgttgaccatcttaaacacataccctcggtccataaatgtaaagcagcgctaaaatagataaaattctaaatttaaacacttttacttgaagaatcattaaagattttagaaaatatgattaaatatattgaagtaaaataacactaaactaaatgtgttgtataattaggtatttaaaaaatcttctaaagatgtttaagcagtcatccacatatggcaactaaaataactacaatttatattaaaaatgaaaatgaaacagggcaatatactaacagagaataggtacatttaaaaattcagaagaaaacaagaaaaattgaaaggaaaaacagaatgaaagcataaatgaataaaacaaaaatatcaatcagaaagttataaatctatattgattttataaaatgtcactggagctttgcaatgaaatattatagccccttcttttttatacagaaagctttagctttcggttgtctacttttttaaccacttagttacattttattattttcttttaataattccatttcacacttatggggttgtaaatcttctcctgtacacactgggtcataatgaggagtggtagagacgagtcaggaaagccttttaaatctcactggccccttttgacagagtagctcctctccttatcagctgaggaagcttgcatttgaaggctgaaggaaggagatcgtaagatttctatcagcgagctgcttactacctttcttattctgtggtcaaattctctttactgtatcaaggagagtcttaaacagtaagtaggcttggaggagcacttgctctctctccaaaagacggatggtcatgtaaccagtaaccaagctaccacggccaaagactgcacaggcaaagtgtggagcaggaggaagggaccatagttcccaacgcaggatctggggaggcactagagcaggtgcctcccatagtggatctgcagctcattacttggtgtgtgagtctcattctattcacccacgtgggtgtgagtaaacatgctgcttgggaaaattccacagctggtgtggagtgcttctttcttgtcgaaagtgtccaggatgatccattaaaatggttttgcatttcttggagtctctcctcaattttactcacagacaggactacacataaaatcttgctatggagagtggaccaagagctctatggaaaacattcatttattccaaaagcacaagctatttaagccaagtagagtagatatgaagggttttcactttttagagacttgcttatccatccttatctgatatttagagagaaataccacagatgtttaaaccaagtctctctctaatattaggtgatttccaaatggttttcaacagctcattgaaacaaagcagtggttagtcaggcgaatgggctaaaagatacggctatccaatcagcaaaataaaaatcagaatgaatcagcctttgctaccatcttggtattgtgcttcataaaaagagtgtctaaataggtatgttcagataagtagagctgtgacccaggtgggtggcaaaaagaaaaatgacaaaagctgcaatcatttgaatcctatttacttcactgagagaatagttgagaaatgtacaagctttttggcataattgctgaaaaaatattactttcccataatgtggggtaagggaggctaccttttaatgtagaacatttttatatgcccacacactggttcccagaggttcttcttgattcttggagaccaattttgagcaacccatggagttacaataatattttaattgttaaattccaatgttgactaattcacagtatttgctaatgtagacttcaataacaaaaagaggtagcagtcatttgaagccccaattgagcaaataactattgtttgctggaaatataagagatttatgacatcagcactaggagtgggctgtgttgagcatctgaaaactcaaatttattggaattgcaccaaatgactacgttcagttttacattttcaaaaatcactttcttttcctttcttttttttctctcctagctcaaatgattcatctaataagtgttccaattttttttaatattatgtgtcaaataaatgccattaaaacttcaaattagtaataaggagggtaactatgaggtcttttcccttttttagagacttgcttattcgtcattttttgcagtttagggaagaatatttcagatgtttctttcaatatattttatttgcaaactgaactatacataattctttctaagtttcctagtaaactattagcatagcaataaactttattcccataggtcttaaaatgtggtagaaaactacagtaacttttcccccctttaaacttttcccctttaacacttatcattcttgtctctttctggaagcaagaaaaaagtaaaaatcagagacaaaaccttgaagaaaaaaataaattcaggataagaacacatacagtgtataatttgaaatagtttttaacacattaaaaaaaagaaattaggctggattaaagctcaccagtgacaagttgggcccattttccacttctataggcttttaactgtatattattagcatttatttatacattctcacactcacccatatgttctggtgactaccattaagaaacaagtcaaatgacttcataaaggttatagtagtcaagagttagactaaagaaggaggcacagaaaactattatctttctaattgcttgcattatctgttaaatggtatactgtaattatgtatcttagttttttcttcgactttgcatttctttcctctcagctcaatataaatggttgtaacccaatgaaatataactaatttccatacatatccagtttagtaagtagctactcaatactttacttgataatttttctttcatgggatcagtgtgatctttccataatgtaaaaaacagcgtgggtcaaccttggtggctcacacctgtcatcccagcacttagggaggccaatctcttgagctcaggagtttgaaaccagcctgggctacgtggcaaaaccccgtctctacaaaaaatacaaaaattagccaggtttgtgtctgtgtcctactcaggaggctgaggtgggaggatcgcctgagcccagggaggttgaggctacagtgagttgtgatcatgccagtgtgctccagcttgggttgacagagtgagatcctgtctcaaaaagaaataaagaaaaaaaagagcctggagataataaacaaaaatgctaaattcctgaagcgtttcccaaagtggctatttggtatcactgtcagagctaaagccattataacatcactttcaaaggcagaaatgtccaagagaataatattactgtagtgcagcttcctttttaaaaatttcattttttctcttaaaatatatttagaaatactatgatttgactgcactcaaatggatacttttctctaaccttagttttttttttctttcttcctgtcttttttttttttgagacagtctctctctgtcaccaggctagagtgcagtggtgtgatctcggctcactgcaacctccgcctcccaggttcaagtgattctcctgcctcagcctcccaaatagctaggactacaggcacgcaccaccacgcccagctaatttttgtatttttagtagacacggggtttcaccatgttggccaggatggtctctatctcttgacctcatgatctgcccgccttggcctcccaaagtgctgggattacaagcataagccatcgcgcccggccttctaaccttagtctttattcaataagacttcaaattgaaaaaaaaaattaaaaagtatttcaagcaataaagatgtataaatgaaagttttcatctgacagtgctagttttgatttttcatcatacatgaagatgtgaactgatgaaagtttagactatcttgcatccaccaacatggggccttgaatagaactgcgatctcatataactgtaccttgagaaatctggcaacgctgtggtttgcccttcttgtttcttcaagtgcatccttgtatttccaaatcacatggtcggataggaccatgacaagattgtccaattcattttggtaagattcaggaaatctctgaggccggggaagctaaggaaagaacggattatatctttctaatgtggcatgtgaaatattaagccgaggaagtatcaactgaaatatttactttattttataggtcattaaagaaaaagaatccttttgaaaacttgaaagcagtaataaaatagaagccttttactttcaaggtcatgatttccatcattaatatttagtgtttccttcaattttggtcaataaaattttcactttataataaaagtcaatcataacaaatattaattgcaaactattgaaacaatgtagcaatgtacaaagtaaaatgtgaaccttctctgtggcctctcatatcttactttccctccttccctctcagggaatagctactattaatggttaatgaacattattctagatattttggacatgtagttctctatttcatttaaaaataaattattttgatttttttacaactaggaatgcccccaataaactagtctaagaaattaataaatgaataactgaatgaatacagatattggtttgaaatgtcctctgacatttggtgagtcccagctagttttaactccctggtcccagtatatgccacagttaagagacaccagtgggacctcacaagtcaagataaagaagggcttggctgtgagatgacattacatccactgaataaagctctatggatctcaaaagaccatttcaggtccagatatccatccctcctgtttggactcctgcatatgaggggaacatttgaggcagccgagttcttccatctcagactctgcttttttttttttttttttttttttggagacagggtctttctgtgtcacccagattggagtgcaatggtgtgatctcagctcactgcaacctctacctcctcagtttaagtaattgtcccacctcagcctcccaagtggctaggactacaggcgccctcctgtagtccatacccagctaatttttagtagtgacagggtttcgtcatgttggccaggttggtcttgaactcctgacctcaagtgatctgcttgccttggcctcccaaactgctaggattacaagtgtgagcccccgtgcccagccttacttctgataagattcattcatctttaccagctggctttaaaaattagacccagacacattttcactatagatagaatcatggaatttagagttacactgaactgtgtatttctaaattgtgagcacccagacttccatgctgcaaggataaaaatcatgaaggctgaagttacaggagttgtatgaaacagatatttaatggaatttaacgggatgttggagctggtttaggctggcttctatttttttttttttttttttgagatggagtttcgctctgttgtccaggctggagtgcagtggtacgatctcagatcactgcaacctccgcctcctgggttcaagcaattctctgcttcagcctcctgagtagctgggattacaggcacctgccaccacacctggctaatttttgtattttttagtagagatggggtttcaccatcttggccaggctggtcttaaactcctgacctcatgatccaccagcctcagcttcccaaagtgctgggattacaggcttgagccaccccgcctggccagactggcttctatttttaagccactttaccaggacatcactgcatggatatttttgaaaatttcatggttactctctatatatttaaaatttattgttgaaatcaaataaattaacaactaatgaacttaactgatttgatcacacacagcatttttaaattctcttccataaaacttgggtaataaaggtaaacaattcacctacaaaaagcaacagtcaccttttaaagaatcaaagcacacttttaattttcaattttcgttttgttagtcctctaaaattccttaagcatatcatacgtacattttccccacatgcatatgcatgaatgccttgggctttaatattccatttgttccttcctctttacaccttcctctcaaagtctcctgtggcctactctcactctgaacccaaagatgtctgcctaataaatatatgagtacttttaaaactgttttcccgaagtatatcctaaagactcgaggtggaagaattcctgcactggagattgtgaattttttgtctcaggagatgaagggagtgagatggtggcacacttcccaagctgcagagctggaccatgatgaatctgagctacagcatggcgaggtcaaggggaacaggcctgggatgcatgggcagaactgtaggcttttgggagttttgttagaaacaaggaggatgatgggaaacaaaaggtttagctggttcaatgatccttttgctactagagaataatgttgagaaaacattcagtggttcccaggaaattgttttagtttgtttgtgttttgttttgtttgagacagagtctctgtggcccaggctggagtgcagtggtgcaatctcagctcactgcaaactccacctcccgggtttaagcaattctcgtgcctcagcctcctgagtagctgggattacaggtgtgtgccaccacatccagctaacttttgtatttttaatagagatggggttttgccattttggccaggctagtcttgaactcctgacctcaggtgatctgcccacctcagcctcccaaagtgctgggattacaggcatgagcaactacacccagccattcccaggaaactggaactcacgctggccaagtgcccaacaacattgcaccttttagaggactaaaccagatatctcccctgacttcctcagatcttccacacttactccttggatgatggaaattcctttaatagtggagaaaaccattcacttcacaatttaaaaagaaaaaaaaaagaaaatacaaatagcttgggaaaagtttactgtgaatgctttggtgtcaaatgataatatcagggctgggtacaatggctcacgcctgtaatcccagtactttgggaggctgagatgggcagatcacttgagcccaagagttcgagaccagcctgggcaacatgacgaaaccccatctttactaaatatatataattatctatctatctatctatctatctatctatctatctatctatctatctatcatctatcaatcatctatatgaaattagctgggcttggtggccatgcctgtagtcccagctactagggatgctgaggtgagagaatcacctaagttggggaagttgaggctgcagtgagctatgattgtgccactgcactccagcctgggcaacaggagtgagaccgtgtatcaaggggaaaaaaaaatgggccatgcgtggtggctcatgcctgtaattccagcactttgggaggctgaggtgggtggatcacctaaggtcaggagttggagaccagtctggccaacatggtgaaaccccgtctctactaaaaatgcaaaaattagctgggtgtggtggcatgcacctgtaatccaagctgcttgggaggctgaggcaggagaaccacttcaacccaggaggtggagcttgcagtgagccgagatcgtgccactgcactccagtgtgggcgacagagcgaaactccgtctcaaaaaaaaaaaaaaaaagtaaagaaaaaagatgatatcaggtcttttcccactgtgatgattagagatggttagagtggaaggtgcagggctcctgaaagaaaactagggtgtgagggttaccactgaaaggggtcacggaaagcaaacctcaatcggagaagataaactgctggacacaatcatgctggctattatcagttcatttattcttaggctgctcacaggtgtgttttgtgacctgtctatacaagcagatgcatactggtaggaactagaagagaattttagtccaatccactcttcttacagatgagaaaacaggcactgagatgttaagcgtcgttttcgtcagctaacaagttagtgacagagcaggaattgcaacagtgaggtttcctgaccccagtagagcttaacaacagagagatacgaaccatttttacctttgtgttagattttctctccctcccaggtaggaggctctcatctccagaagtggagagcagaaatagcagaaaagcaaaaataggatttgcgagttaagagttatggaactccacagatgattaaaggtccagcaagccatttctgtcatactagatcanngccatggttacatagacctggggcctagaagcatggatgaggacctctggatggatgactctgaggaagtggctctgcacacttccctgaagccttagtgctagcagaagtttaattcctccctattaagtgtcagcactcctcccatgcaagatgatattgcaaaggcctctccctgctagaaatcaggcaaacccttgaggagttgtcccgcctctccttctggtgatcagggcaatacctggaggttaaatcctagcttaacccagctgggggcttgctgggcctaataaagcaggaaagagaatatacccaaagaggctataaaaattagctatcatgtaccaccaggaggtagggcagaacctctgcaattgtacattgaggatgtgggccagaaagtaagggcaggtaacttagaatgcattgacatgggtgtgctttttcagaacatgggattaaataaggactcacgggatgagcaactcactgctagggttgctctgagaatctagagatggcctactttaagcaaagtcgaaatgtctggttgtcctggcagaggatagaggaaaaaataaagaggtggagggaggtggatatacaggaatggacattaattgagactggaagatccaccagtgtatcaagttccccaggcaggcccagaagacagcatgcaccatggccactaagaaggtgctggggaccaatatcattaagaaggtcaggggtgtttcccatctgttggcaggaggagcagtcacagtcttggctcatgagcagccatggggatcagggatcaccaaaacaacagaggccatgtgctgtgcttaatctccaggagccagggggctgtgagtatcatgacaaatgacaagactggtggggaagccaagagggaccgactctcagggagttgtagagctggttaatgatgactggaactcctagggacaaaacagagagcaaccaacaatggtggtacatcatattaacaaagaaggcaagaatgggcaactggaagatggggatgttcattccaatgaatagtcatggttcctttgtctgttcctggacctgagtcacaattcagatctggtacacattgactgaagaggtgatggggtccctaaaggaaagcccccactgcaacaatgcagtagatacatactgtaatgagtctatcaattcttctccaaagggccctatagccatttactcaggctactgtacactgagaagaagggcatatagttcaaggactgttgcacacagaatctgagttgacattgatatccagaaatgaaaagcatcaccatgtctgccctgatagagtggggacttacagggattaaaggtggagtcctgactaaagttctgttaacagtagatccactgggttcaaagatccccccaatagtcatgtaactggtcccaaatgtataatttgtattaataaaactggcatttggagtaagcttgcacgggtgcttggtctgtggaggtatcctagtgggggaggccaggtgggagcttctgacactgcttcttccccaccaaaagagtaaatcaaaataatataactgtacaccaccaaccccacctcatgcagcattgttatgatttaccctccacgtggggcaggggcaatgccagaggtcttcccttggccttacccacaatgggggctcagagaaatgtgtgtggaactcaggtgatctacctggctgcttcttggtcttcctcactccattgtaactgtgaatggccataggtaccaactctggtgtgagtagagtatgatgaccagaggctgagaccactctagaatgagggtttgggtcatatcaccaggtgagtcaccaagaccttcggagctgctagttagagtgagagggatctagaatggagagttgggatgggagatgatgagtaatacataggctcctgaaaagccatggaaggggctgtaattaattccatcagggtccctcttctaagcttcctttcaggaggggaggcccatgggaactgcagggaagcagattcatgaacttgtacaatatgtcatgcaaacttggactgtggcagccaggaatgcacatcgctcaaatgttccttcaagacagaatctagtgggaagaatataaagagttgctgtatcttgcaatatgctccagcattcatgccaaggctaccctccccccaggctgctcccagtcaacgacttagcttgcaaaggtcctggaggccgatggccttcccagtgcagggttcctctaatgacaactctttgctctcagacttcccatcagcccagctaaaaccttgtcactgtgagactcttcctagccaatcctccttccttcccccttttcatttacaggtatcagactttcccatttctttttcctgttccttttatcctttatagttatttccctccaatacatcttttgcacttccaatattgtcttggcatctgcttctgaagggcctgtgccggttggtgtacacaatcatttcttctacttataaagtaattattgtaaactgctaaggtttataaagcaaataaaaatggaactcatgacagcataatcattagtgtaattgttggataatattgtaaaaatattataatattatattacttatgttcttacctggattttatttgtgtcaatcaagtgctgtgccatcgattttaggataattgcaaagaagaaccaggaatgctgttgggaaaaaaaaggcaacgagacatttattatcctatggcaaaataatgataattttttctttgcaatatgtaatactataacattgttatgttaaaatgtattctttgaaactaaatgaattagagcagtaaaatattctctattatagtgggatgatttttatctcaatcctctcaaaaaatgtttaaactaaaacaagttacaagtttatttggcatgactgactaagcagttgttttacaaaatatttattcaagggatgttctagttgtttcacctagttaaacaaaactaaacaaacttttatttatttatttatttatttatttattttttgagacagtctcactctgttgccaggctggagtgcagtggtgcaatcacagctcactgcagtcttgaactctccggctcaggtgattctcccacctcagtctcccggacagctgcgactacagatgtggtcaccatgcccagctaactttttgtgttttttcgtagagacagggttttaccatggtgcccaggctggtcttgaactcctgggcttaggtgatcctcccgcctcagcctcccaaagtcctgggattacagttgagagccaccaagcctgacctaaacaaactttttattgtaccaagctcacccctcaaatttcaaaggttagaggtaagggtgaaaatggaaggtcatatgtctagatatctagaagttggaagtcaagctgaaaatgtgttaaataaaatatgtttgatcctcctacctcgagaaacaaaacttcataacaccttggaatgctgccccagggtgtgaggtcctggggggcacagggcctggcctgccccttttcttctcgcccaaggctccgtcctgccccttgaggggcctggtgcgcatgtgttaaatactttaaaaaacaaagcttcaaaacttatgtcacctaaataactcaatctcaaaattatctgctcatgccagattttgtcatgaaataaatgcaggcccaatgataagagcagtacacacctgttcctacttagggctttgcagaggtagggccttgtacgcctgagctcttttggaaactgtccagcctgcacatctgagtgctgtccacaacctggccctcctccctgccgcaaatagctccttaatggggtctagggttgcactcaggcatcaagacctgtcctctggaggtcctggagggcttgggacagagattgaagcaggcctggaaatccacctataggaccttgagcaagagggtcttggggttccttacaggtctagaaggggaggtaggggctcctggtgggcttgttctcttagctcctcttaaaccttggcctgtgaggacaggtgcagtatgagaagaacaaagctcatcccaggatgggcacccttctttcttgggcctaagggtgacacttatctcagctacaaaaagtcatattgtatatgtatagtttcaagaacgcaccccttgcatcctctctgcttcctactccttccaccacagataacagttttaaattttgtgctaatcattcctttgctttacttcacaattttgctacgaatacttatacaatgaagggatatttagttcatctggccactgaacttcataagaatggaactatcctctatgtattcttctgagattgcctttttcattcaacaaattctgttctgtggttcgtttatgttgaagcacgtagctggggggatcacatatggtcaccacatgacatatataatcaccatgtacttatctgctctactgtcaatgggcatttggattatatcctgttttaagtcatacaaacaatgctgcgataaacttttgacaagacagtcctaattccagaagactgactcagataaaaaagagaagggattgatattctacaaaggcagctatggcttaatgaagtggtcacttcttagtaagaagaaatggaaatggctaccaatactattctagcactccaatagcattctaatggctattagaagtgaaacatgttgttaggaatatgaatgaatcccaggcacactgctgcaatcctctttccctaatcttgtccaaaatattttgagccatcgtgtcaagtgttccaacatttgtctcttaattcaacagactcctacccctctccatcccttagcactctggcctgcctccactattttccttgaaaccaccagcactaatgaaattgagcttttgcctgttcacgtctgatgacagatgaagcctcaactcctctactgccctctccacatattcccttatatatctgcacattccactgcttccaatctcctgaaacccacccaccccaccttccagagcacatggtccatcgttagcacaatctcttgaagatgcaattcttctccgagcattcccttcactccatattttaactgagcagtgactctccccagaggatcctgcttctctgatagcccctcaagtggttgtggtctccatttttatcccactgtagtcgattctcaacacagcaatcagagggatccttttaaaccaaggtcagcttggtttaaaacattactcctctgtgcaaaaccctccaacgacacaactcccagttctgctctgagtgggaacgcctggcctatgctaactcccaagcctccagtggcttccatgacttcatcgtccatcttttttttttctttctgctcacttggctccagccacagtgtcctccctgtctcctgccacagtgtcctccctgtctcctgcagacacaccagccatgctgctgcctgatgacttcacacaggtctttccctctgagcatccccatggccagcaccctcttcgccttcaaattttttttttttttgctcaagaattacctcctccatcagatatcctgaccattctatttaaaacttcaaatctcccctgcaccttcagcactcacaatgcccaattcttacctgttctacaatttttctaatgcatcttcttttctaacatacaatatctatctatgtatctctctctctctctctctctggtcttgttgcccaggctggagtgcaatggcatgatctcggctcactgcaacctctgcctcccgggttcaagcgattcccctgcctctgcctcctgagtagctgggattacaggcatctgtcaccactcctggctaattttgtttttgtatttttagtagagatggggtttcaccatgttggccaggctggtcttgaactcctgacttcaggtgatctgcccatctcagcctcctaaaatgctgggattacagaggtgagccactgcacctggcccactctacttttttctatgttgtctcgatatagatctcttttgcttagtatctttatatgctaagtttcaatatgaaccttatgctggaaactgcaagagaaaaagtctatgaaaatccatgactcctatcattttccaggagtaagcgtgacccatgcctagtactcacagttaaaggaccatctttaaattcttacctttaggacatgctttactgttgttgagtcatttgatttcaaaagaccagtcacatttttagccagttcctcatgtacagtcctctccttgcatgccctggtcttgaacacgaactgaagaaaatccaaaaagtgaataaagttaaatactttgaaaaatgaagcttcaaaaactatgtcatgtgaataacttatgtctctaaattatctgctcatgccagattttgccatgagataaatgcaggcccaatgataagagcagtacacacctgttcctatttagggctttgcagaagtagggccttgctcacctaagctctccttgaaactctttgtagaaatcaagagaaagagccagagagccatttagcacgttcaaggaaacatggagggctttgacccacctacttaggacacattccccttctccttcctccactggtaacaggtggcatggtagcaattcttcatcctgaaagggtagagcacccactcaaatagccaagtggggaagccagtgccttccagatgccagtacgtgagctccccacaagcccagggtctatgatcccatgcttagacacactatcaaggcgttcatgaacattggccatcagtaagataacaaatgctgcatacttattttttttcctcaaaaaattggttttggcatgcaccactgagggcacataatggctagttttcagtatttcttcatctcttaagaatatcagtatcaatttatgcacatacataaagttcaaatataaaatgcttattactgaattataatatttcacttatgaattgggtttgcctcgtggaaggacatttcttcataattttcacaattcggatttcaccgtaattgagagtgaaggcaggaaagagaaggaatggcttaatgtagaggcacattagcttttggatctgtaactgtttctttaaactttgtagcacattggcacctaacttgtcatggtgggatttgacttctccaagctcatctcaaaggagaaagatgaagttaatggatgcatgaaactagataaaatcaagagtaatacaatttttccctctcatgggttatacctcagatgtgagtaacgtcatcatcaatgagctcatgccatgcacagttatttagcctgaagggcatttaaactggcactgaaatattcttattttaaaattttgactgtaacccatcagtgctacaaatcactgttaaccatggcatttaattagactggctttagacacgcatctttgaaaaagacacggtgtatgtgtgcattttgcatattgtagacgaagtgagttagcagcatttagcaccactgaacttgaaatggtgtttagataacttctaaataaatacaaattgtattgaatatcacatctttggaggacattcaagcacgcactgtaacaagagtccaatcacaggatgatagaactgaatgttcctttggtcatttcatctcatgtcacaggagaaaactgaggttcagagaggctgactgcttaagtctagaattgactagaatctagtctcttacttgccagcttagtgttctttcccgagtaaaatgcgagttgattacatttattaggaggtatttgttttagatatgttaaaatttattataaaattgttatcagcctaaaattccacataggtgtatttttggatttgaatcacttaaagcaagctaagtagataatctcctgtattataaagtgagatggtcttgttgggtatttcagataccctggttaaaaataaaggtcacgccaggatgcatttctaatgcatctctccaggagcgtcaccggtagaaagtctgagatttgaggtattcacaaagagctagccttggtaatcacaaaaatagtcacaacaccggaggggtcttaatgtaattttcaatgatcccactgacatgaggaaaataatatgtgttgaaatggagatgcctgtgtgtaagatggatcagtaactttttttctctttctcagtccctttaaggattgaaatgaaacattcgggtaatgaagcattgagagggtgaaagttctccaggtgattctgttgaatggtaaattcatcgatactctataaaactaagctatgaccctatcttagggagcaaactaaaaaggcttgtgtaggtggaactggctttttgcagttgagatgtggatcttattgggtaaaattatacaatagagaaattattgtgaaataactatttttggcatatagcctatgtttaaaaagggcacatactcatgctttggcatttgggaagacaactaacatttctggcagatagaaaacatatggatataaaaactgtaatgaaaaaaatttccttacagatggtatctcagaggggttcactccagaatgcaatttctggttacttccttttatgggagtgtggaattttttttttttttttgagatggagtcttgctctgttgcccaggctggagtgcagtggcacaatcttggctcactgcaagctctgcctcccgggttcacgccattctgcagcctcagcctcccaagtagctgggactacaggcgcccaccaccacgcctggctaattttttgtatttttagtagagacagggtttcactgtgttagccaggatggtctcaatctcctgacctcgtgatccgcccgcctcggcctcccaaagtgcttggattacaggcgtgagccaccacgc

SEQ ID NO: 15173 - DNA, 202 bp, Homo sapiens
ttctttttttttgagacggagtcttgctctttcacccaggctggagtgcagtggtgcaatctcagctcactgcaagctccgcctcctgggttcatgccattctcctgcctcagcctcccgagtagctgggactacaggcacccaccaccacgcccggctaattttttgtaatttttttttttttttttttagtagagttggg

SEQ ID NO: 15174 - DNA, 2430 bp, Homo sapiens
ccactcgggagccgcaacctagaagccagagttgtgtatcagattcaactaggagaaaatcccacctccaggctccattaatccttccaatggagtggaagtttctctcacagagaaactagtaaggggatccaatgggaaaagaacgttcacacggactagaagacgaaaccaatggaatggaaaattgtcctcgcgttggtagaagcagccaatgagatgaaaagagcccgcctccaaagtggctgcagaggcaatggggtgaatcgtgctcagaggcgcgctccaatggggtagcagggctcgcccggccgccactaccccgcttccccgcgcccggagtccccacccacggccggccgcggagccgagtgctgacccgggtgagaggttcccgcggctcagggaagatggcggcagccgtggtgctggctgctgggttgcgcgcggcgcgcagagccgtggcggccacgggggtgcgcggggggcaggtgagaagtggcgcgggagcgagtagggggtcctgcgggctccgaagccatccggggccagggggtcccgaaggcgcgcagagccgcgcagagctcctgcctgtggcctctgcccctccgaggcacaagctccggggctgtgtggtgaggtcgaactggtggctccggagaacgagctggtgctgattcccgccctgcgcaggccggggcgccgaggtcgggacagggtcagtgcagcggctgccgccttctttccactgcctgcagcccagctggcccgatgccccctgcaggaaatgagctttctcttcttggagccagtgctctgccctcctcaggcttctggcctcctaatgagcactagtgttaacctctcttctgcacttgccagaagcggctcggaggtcagagaattcattccgtcccgttctcccccaacgtgatgcaatgacatcagccttctctgaatcccttacccgaagttccctggggctaggggagcagaggtcacttagctgaactcttacctccactcattcaagggacaagagttaaaattcacagagtcacatgtgacacccagatgaggggtcaactagtgtcaaacagggcgattgcattaaaacttaaataaaacaggcgacaaggcttaaagatcagaaaacaagtaacggaaataagtggaaatgtactaacaaggtgagagtggaaagagattcaagccatcgcaagagattatggaaaccatccctttattttatattagaagctgagagaaggaatttatctgaggtaattcagtggtatggtaaggtaggaactgagaccaaaatccccagtctctcattctagatcctttccctaaacagtgctatatttcgtggacacatgagcaggaatcaattgcactgctgaatcctgataataataccgcctgttatctaaccaggtccagcaccttctggccctaccctttgctgctggtgctctgaaattcaggaactttcctcctgggtgggaacgatgaataggttattagaaggacgaaattaacaactatcagagcccagcttctgccagctccctcctttgaatatggtcgatccaccttcaggtccgaggagctgcaggtgtgactgatgggaatgaagtggccaaggcccagcaggcaactcctgggggagcagccccaaccatcttctcccggatcctggacaagagcctcccagctgacattctctatgaggaccagcaggtggggtgctcttaggacctatccccttaggaatgttgtagataccatccaacctgttgaagtaacgtggcctctggcctgtcacttcccccagtgtcttgtgttccgtgatgtggcccctcaggctcctgtgcacttcctggtcattcctaagaagcccattcctcggattagccaggctgaagaagaagaccagcaggtgggaagaacagggccagggtttggctgggaggagcccctggacccagctagaggtcttgctccctatgaatgaagccacctatgtccctccgctctctctatagcttctaggacacctactccttgtggccaagcagacagcaaaggctgagggcctgggagatggataccgacttggtgagtgacttttggcccttggtccctcacctatgaattctcattcctacttctcaatatgatcttcattcttcgacctctgccatgatcctgactccctaaccccaagctcaatttcagtgatcaacgatgggaagctgggtgcacaatctgtgtatcatctgcacattcatgtacttgggggccggcagctccagtggcctccaggttgaacctgccaactgattaaaggacaccagactctggatgcttggatggaaagggaaaaatggaccctgtgatgctaataaaactgttctcccttaa

SEQ ID NO: 15175 - DNA, 2373 bp, Homo sapiens
tgtctctatggcaacccagtagctggagtctgaagatggagaccaacgagtctacggagggatcgcggtcgcggtcgcggtgagagccgcagctctggctgcaggcataaggggacgaggaaggtcagctgacttcctctgctgcgcttttgacagccatgtcgtgtttgctttctttcagatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagaggtattaaagttttggcctgctcccttttcttgaaggctgccctcagtttcttaggggaggcagtagtttacatgagggtgggtaccagaagggatattatagtcattcaacttgggatccacagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgaggtgtgaaatgtgagagggtaggccagaacgagcccattactcagagggaagaagaggaaggaatttctggtggggctgtggattctccagtggatataagggcggaaccccaaggttcttcttccttttctcaagttagtttcttctgggcctccttcttaaccagaccccaccttgcccaccccccaactctctcacagggaagcgtgaagccatgctggagatgctcctgcagcatcagatctggtaagggattgggtaaaggggaagagggatggggaggagaaaaattgggtgagaatggccttgacacccctcgggctacatagtaaagaggtgcaggcagaacaggaacccacaaggaagctcttcgaggttgagtctgtgacacaccatgactaccgaatggagctggcacaagcagggactcctgccccaacaaaggtgagaacccaccccccatcccccgccacttgcaccagctgggctctgacaggctgtggccaagtaccaagcccagaggttgagagagagggctgaaggccaggagttactcagtaccctccctcacagcctcacgactaccgccaggagcaacctgagaccttctggatacagagggcaccacagctgccggtgtgtgagggtgactaggtgttgggggcagagcggggcaggaaaggtagggcagagttgttttgttctggcttggggagagtgggatccatcctcatcctggcactcctccagggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaaga

SEQ ID NO: 15176 - DNA, 317 bp, Homo sapiens
tggtgcctcatacctgtaatcccagcaccttgggaggccgaggcaggaggatcacgaggtcaggagatcgagaccatcctggctaacacggtgaaaccccgtctctaataaaaatacaaaaaattagccgggcgtggtggcgggtgcctgtagtcccagctactcgggaggctgaggcaggagaatggcgtgaactcgggaggcggagcttgcagtgagccgagatcgcgccactgcactccagcctgggcgacagagcgagactccgtctcaaaaaaaaaaaaaaagaaaaaagaaaaaaagaaaaaaaaagaaaa

SEQ ID NO: 15177 - DNA, 44602 bp, Homo sapiens
gattgaaattaggcccagctttgtatgattctgactgagaagtctggtaggtctagggcagtattcagctagaatgcagaagacaaaagtcttttccaataagacttcaccttgggctttaagttgtttctttactgaattctgtttcagttgaaggagtattcacagaaggctgtggagattctgcggactcaaaaccatattcttaccaaccaccccaactcgaacatttataagtgagctttgttttgctttctacctgtgggaagctcagtcagcattctgaggagttatttgcatggtgataggctcttacataggaattgacaagcgcctgagagaagagcgaatctgcctagttgagattccaatcccctccatgtaggccagggtcttgcaaatagaaggtactcaaaatgtcattgctgagttcagggtttggtgagtagtaatgtagaaaggtctgtatagcctgggcaacatagtgagacttcatctcttaaaaaaaaatttaaaaaagttagccaggcgtggtggcgtgtacctgtggtcccagctgctggggaggctgaggcaggaggatggcttggggccagaagttcgagggtgcaatgaactgtgatccacgccactgcactccagcctgggtgacagagtgagaccctgtctcaaaaaaaaaaaaaaaaaaaggtctttagtttcaagggtttaagttaaataaggtgaaacaaatttaaagaaaatgtcttcctttttttaaaaaaacttctaaaagaggatattggttaaattgacagtttattatttctctggtttagtagtgactgttctttaaaaaaaatttaaaaaaactttattgagataatttatgtattaacctattttaaatgtacagttcaatgatttttagtaaatttaattgtgactcttgagtcaaattttactactttttagaattcctctgaaggatagatcaaagattaggaaacatctaaggtcagttagttgaaatttctttcctgtggcttcgtaaccctattgggatttctcctgtgtccttgagttctcactagggtggggctcactttgggctcactttggctcacattgagccatggctttgtcatgatttttttgtgaaactcagtgcttcctaagatgaaaatgtgttcatgctaagactggtttcttccttagcactttgtctggcttagtggagtttgatggctattacctggagagcgatccctgcctggtgtgtaataacccggaagtaccgttctgtgtaagtaacatctgtacatggacagtcctgaggccaataggtccagtgggattcttgtttccagagatggatcattatcacatagatgttcctctcctaatggttggtcaccgatagtaggaatttttatctgccacatttattaccttaaatagaaacttggctgggtgcagtggctcaagcctataatcccagtactttgggaggctaagatgggaggatcccctgagcccaggggttttagaccagcctgggcaagatggtgagaccccatctctacaaaatattttttaaaaaattaaatagaaacttcatcttgtggatgaagagtgggttacactgatgaatttttaaaaaggcagtacgagtcttgaactaataccatgttttgtgaactcttgtatttagtatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagtacgggctttttaggcctcgggaggggcagcaggttgtaaggctgaagctcagttgctgccttcggttcctggaatggagtaaggcagcacatccctagaggcctaatacatcctcttggcccctccattcatgaccaaaggacaaaagtgaaacaacagttctaagcatgttgacaaagattatttctaaattagcccagtggagccataggggtctgtggaagttcctcaacagcctgcctagggaggggaagctgagtgaggggacctccaggcttctcatgcccattttaactattcttacacaaaggtctagacttagataaaaccttctgtattgggaagtaattgtcatttcttggattaagacagctatgctcttgctcacagggcagaaagttatttctcaagaagcttctttagtacacacactcttcgatttccacatggtgccttttctctgtatctgctgatactggatcttcctagcccatgtatcccagtgactgaaccagggcatgtcatatttaggccaagagaggcactcacatgggttatagtgttgactttcacagagacagatcgcctttttttgaactctcaggcattgctactgaagggagaacacaggttgacactacttgaatagtaagacttacagagctgttctgcacacaggatggaagtattgctgttattccaagaggcagaataaggctcatgtaccacagcaacacgtggccatgaaggctgcctagggaggttttctcttcttgccttgaaaagcctagtttaaccttggtgacctgaaagtagatgctgcacattagggtggcccattcccctccagaggaggtgggtttgatttttcattgtgtggagtcagcagagctactggtagactatttgggttcagatcccagctctgctacatagctctgtgaccttagagaagctgcttaacctcagtttctgtaactataaaatggaggtaggaccccacttccagggtttaaggattaaatgagttagtatgtgtcaggtgctgagaacagagcctagtacatagtaagtactcagtaaatattagctctcattgtgttatataatcaccccaaaattattacataccttcctctttatgacttgacttagcacttggttcagaccctgattttcttcctctgcctctctaaaatagcctgggtttatctttccaaggttgctgtcaggatgggaacttggcatgcatcatcattgcacctcttacaggcttcagtgtggcatgcttttggagtcatggtttcccttgttatatacttctgttgttttcctggaatttcaaaaggtatcatgtataacagcttaaagcacttgtatgttctttcctttttttatagagaaaaggtagtagaaaacttttttaaaactggcttcctattatatgccagatttcttttccttagagtaaccacttaattgccttagaaaaatacatgggacagtcttcctctttgtctcatcagactgttatcactgagggttagatgagaaaatctcaaggctgtctgtctttcctaggccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcaggtaagtcattggtcatcccctaggccagggctgtgcacattccttgttatttttctgtagtagtgtcagtgtgagcaattacagtgtctgattccctcagaacatttagagaattatgggtttgtagagtgggttcaagggtagaaagggaggaggaagaagagagagtgagtgagtgtgtgtgtgtgtgtgtgtgtgcatgtgcacacgagtgtgtctgtcctgtggcaggggtggagggtaagggcggagggaggtccagaagtttagctctgggtcttgctttcttgttacctggctgcttaagtcattcatttgttattgtcccttcagtagcccctgcagtagttaccagagtatataaatgtggcacaatccatttcctcagagtgacccccaccccacccagccttgtcaccttactgacccaaacgctttggttactcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggtgaggccagatctggcctagactcagggctgtggccttgatctggactttgggcagacctggtgcagtgcagtgcactttactttctagcctaagccttcttcgactcaacaccagtttcagggcccagcttttgggtgggagcaaagaatggcatgaggtatattgtattgaaagacatggtttgcataggattttagaaaagtgttgattggtaatgaaactagagtatctccaggtacagataactttggatttggatgctttgccctgcatttcttccacagactgcttcatattgaggctgctggccctccctcagtattagattgtccagtgctagttcccagcctgcataatatgggcaggggcggggggaggttctagatattaaagaacagtgaaaaaggggcacctatagggttaacagaagaacatttagctttggagtcagaaggacagaaattctaattccagccatacttttaatacttgtgtaacctagtataagttacttctctcagcattgtattattatatatcacagatgtgtattgtatttttattagaaataatatacccacctcacaggaaagattattgtgaagaacagagataatgtatgaaacacagtgcctgacctataggaaatgttctggtaaatggttagcagtgaggattactcagggaaagtcatcagccaaaaagccttcactcagtccctgtcttttcctgtctaggctgtatccaacatcaatacacttttggacaaagctgatcgagtgtatcatcagctgatgggacaccggccacagctggagaacctgctctgcaaagtgaatgaggcagctccagaaaagccacaggtagtcccacgctgcaaagggcatttggataagggcttgggtcttgatcagaagactgcctcctaggtgagatcaccttaggtggggagcctgacagcttacctcttggggttgcaggatgactcaggaacagcagggggcatcagctccacttctgccagtgtgaatcgttacatcctgcagttggctcaggagtattgtggagactgcaagaactcttttgatgaactctccaaaatcatccaggtagagagcggggagcagcttttgggtgtgttttgtccaagtgttactggtgttgttttcacagcagtcctgctgctctctcatctagcagtccaggtcttggtgttgtccctgcccaatctagctgaaaaggcaggcagatggctgcaccaaacggcatctcccccaccgtgatttatggcgctggtcagaatgctgagttcatgctagataactgaacatactggtgatgggaaggtaacacagataagggttttttttagccattaacaacccatctcttagtagaggggttactggtcttaaaaaatttgatgccaagattctgttccctcttctgataacgccgtgtttgcaggctgtagggtaagggcataccaactgcaatcaaccagggtgggccttgtgtcagttgcaatgtcacagacctaatctccatgagatgggaggctggccatagacagaggtacctcatataaggagagcatccagtttaccttccccctcaaccccaaattgctggagtgccatctttgctacacgtgtattagcttctgacctttgtctttgttacatgggagttaagagcataagcctgccatctgagtctgagttctgactctgccacttatcttggtcaagccactttctccaagcttcagtttccttctctgtaaaatggagataaagcatctaaccagttgggttattgagaagattaagttatataatgcatgtaaagttttttctaaagcaaaactaattttctaattaacatcctcttcttattttaattgctaattcccattattgttgcctttttgttcttagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcggtcagtacctacaccatggttatgggcctagtggttcctactgacactggcagccatgccaggagcgttagagagtgcacagaatagtgcttctgaccacccagcaagttaggtagcttataacaaaggaaagatggaaagagacacagggtgtaggtgagcgagcttggggagcattgaaacccaggtttccttgtaaatggcatgattggcttgtgcttttttggttccagtacagtgtcttgaggaaactctccctgaggccttgtgagggaagggaagggagacacttgaactcgagaaagactcacatgaaagaagcagagcagtggggcctggagattaagagcttggactctggattggaaaggctcagtttcagtatctgataccttgtactatacgccttggacagattccttaatttctctgagtctgtgttttcctcatctgaaaaatactgacagtaggctgggcacagtggctcttgcccgtaatcccagcactttggcacctgaggctggcagatcacttgaggtcaggagttcaagaccagcctggccaacatggtaaaacctcgtctccattaaaaatacaaaaatagggccaggtgctgtggctcatgcctgtaatcccagcactttggcaggccaaggcgggtggatcacctgaggtcgggagttcaagaccagcctgaccaacatggagaaaccccatctccactgaaaatacaaaattagacaggtgtagtggtgcatgcctgtaatctcagctacttgggaggctgagacaggagaatcgcttgaacctgggaggcggagattgtggtgagtcgaaatcgtgccattgcactccagcctgggcaacaagcgagactccgtctcaaaaaaaaaaaaaaaatacaaaaatagggctgaacaggctcacacctgtaatcccagcactttgggaggtcaaggcaggcagatcacgaggtcaggagttgatcatgaggtcatggcaatgtctcagcagtgggctgcatgcctaggaagtagcaagtgggtagttgagagcaggcacctgccaggaatgctagggcatcacaaggaacccgtgtagctggagacagggatgcagtagggaagactcgggaggaggcttaggtcagagggtgcgagggccagatcccatagggtcttgtgggcctctgtaaggactttggggcttattcagtatgttgggaagcaagagtgagtgatacggtttgtgttttttattaatagtgggaacattgttacaaagagacgtaaactggaatatgagggccttgtggaaaatgaaatgcaggcagatggagaagacagggaaagagttgtgaccaagactgagagtggacgtctaggttttggagactgtgtcacaccagacagcaggggctctgtcgcctgggacatgggccccataaggtggtgctgctcttccctcagttagcttctgttcataggcaaggcggctgtaatgggccctttattattaccgaccacggttttgtgaagctaaagttctagtcttgccccgggaaggaagtagaaaatttggggccaggtagccttagacattgatttcattttccctgggccccttcaggtggaaaggagtgtcacacctgattgtgaattataggactccatttctatttgcttctgcagagacaacccagaagccacccaacagatgaatgacctgattattggcaaggtctccacagccctgaagggccactgggccaaccccgatctggtgagccggcctagcaggcccagctgtcctctctgacttcccctcacatgccttgtgtttctcagcttcccctcccaggtcctgcggtgactgaggagggaaggagcagaacattaccccagaatggttttcccagggaagagcctggagcacaagggtctccgtctgtcctttgtctctgttggagccacctaggaccagaaattgtattaatagttaagagtcgctggaccggagctgaccctcttgactcatgtctcttcccattgccttctaggcaagtagcctgcagtatgaaatgctgctgctgacggattctatctccaaggaggacagctgctgggagctccggttacgctgtggtgagttaggggattttcagagaaaggaaaggaggctcaaaggagcagtcctggccggactgggaggggaggagggaaactgatgcttgggcggcctctgcagagcagatgtgtagtgttcctgattgtgactctgcctttcctgaccatccctagctctcagccttttcctcatggctgtgaacattaagactcctgtggtggttgaaaacattaccctcatgtgcctgaggatcttgcagaagctgataaaaccacctgctcccactagcaagaagaacaaggtactgggccaagcaggggtctaacaaggaagggcagggcggccaccctcctcattccctggcagtgtgccctgcctcctcatggtctccgctttgccttgagcccacctcccctgagaggctccagtgcagcctttgccttagttcagcagatatgggttgggatttttgagaaggatggttcaagtaaaataaacatgaaactgcaaagcagagagcaaagtggctagctgtgaaggatgaactctttccagtcatgttagataacttgcagcccccagaaagcattgtgtccttcctacccctgtgcctttgcacatgcagtgctgtgcggtgatagaaatcccaggctctgaagcagacttcctgagttcaaattccagcgcttccatttattagcatcatgatgttgggcaagttgttccttagtttccccatctataaaatgggaatatagtctccaccttgaagtgttgtgaaaaataaatgacataatgcagactaagtgatcaaaacggtgtctgcctaagttaatccttaacaaatgttagctgtggctatctcctgctttctttgcctagaatgttttccttcactttgttagctgctccttagagggtcagttctctactaggctagctgtgagctccttgattccaggaactggaccatcttagtaatactttttatgtctagtatataggatggtataacatctataatagctgcttagtgaattattattaagtgaataaatgaaaccaagtttttatcctaaaataactgtagctgagccacagattgacttgcttgtatcagcttttgaattgggaggccatagttctttctttgggccatgcctaaggctctgccaccaacttgccctggattgggccttgggtccttctgactcctgttctgtctgatgggccatcccttttgggcaacagagtcctcatggcaggaagattgctttttgagtgctaagcactagggttatgatgtggggaagctggacattgaagctgccttcagaaaaggcagcacggggcactctgcttccttccctttgatggaggaattatttccccccagattcccagcaactaaaatcagcccttggttgagaagaggacacccatccctatatgaccatccttgtttccacagtgggaggcaaagggagatttttcacggaattacttgccctgtaaggactgaggcctggtgtggatgttcacaatttgctccgtgtaacttagcgagagcagcagttcctaaaatctggctcacagactccggggtgttcttgagactgtcaaagatctgtgaggacaaagttattttcataattgtcctaagacactatttgcccctgtaattcttctgatgtttgtgctgacggtagaaaacctttgctgctggggagacagccagtgccttaggttgacgaggcggtggccctgtgcagttcttcactgccacccggtttcatcaagaatatccttgatgaaacagtacaaattaattttattaaatctccactcttgggtactaatctatttaatgctcagtgtgacaaaatgagtacacagaaagcgcctctgctgcaccccaagtacagcagttgtgctgagaaaaggcacttgtgtgagatgcaagccaaaccagctgcctttccatggatctccgcttgtgcttgaaaaaaatggctgatgggcaaattgtggttgttcaggcttaggtatttggcagatttttcctcaaaatgaatgaagtgagctttaagaagaactgacataactgtgtaaaccagtgttttctaaatgaccaatgcatgttatagtatcctgccgggtaaaagatgaaggttagtgtaatgaagtatgaaaagtttattgatgtgatttcagagtccatactacagctaatctttcagaccctgtaatttgttgagttttggtatagtctcaatgaaaaaaatccacaactagttgaaaaaggtattaaaatattctttccttttccaactgtatatctgtatgaggccaaatgtttttcatatacttcaaccaaaacaacctgtcatgacaatttaactatagaaaccgatatgagaatccagatgtcttataaagcagtcattaaacaattatcaaaaatgtaaaacagtgccacgtctttctgtaggttatttttgttttggaaaatataaaatttatgttgacaaataatagatttactcttctttttcaatgaattaacaaatatcttcagaatttctcagtgttttattttttattttttttttgagacagggtcccattctgtcacccaggctggagtgcagtggtatgatctcggctcactgcaaaccctgcctcctgggtgcaagcaatcctcctgcctcagcccccttagtagctgggactacaggcatatactaccgtgcccagctaatttttttgtattttgtatcgaaatggagtttcaccatattagccaggctggtctcgaactcctggactaaagcatcatctgtctgccttggcctcccaaagtgctgggattataggcgtgagtcaccgcgcccggccagttttagtttttaacatgagaaatggcaatagatacaaccatgtaaagcaaagctctctggagtccgtaataatttttgaagattgtaacagggttctgaggccaaacagcttgagacacgctggactggagtgtcatctgtggctctctctctgcaggctgcttctggttagtgacagtttgcattctggaggctgcttgtgaccctaggaaggtttttgcttaggaaactgcaaatcagccgtgggataggaattagtgtaagtgctataggattgtaggaagccagccacagcttctgctgcacaataaaaatgagtgaccttaagctcaatgtggagatgctgctgctaaattggatcaaaatggtttaacaggaacacatatttgggcataagagatacacgtgttgatcctcctgatcttcttgcctttgcacatcaccccctggggcaccagtgccatgctgttggggctatggctcaggtgtgcccttgagcgccctcaccttgctccacttgcctcctccaggatgtccccgttgaggccctcaccacggtgaagccatactgcaatgagatccatgcccaggctcaactgtggctcaagagagaccccaaggcatcctatgatgcctggaagaagtgtcttcctatcagaggtatatctttctcttcaagacgccgggaagtcctgcctgcgctctgacagccctgccttctgtcactctcatttacttacctactacccctgcaacccttggccttgcagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgagtggccacttctggactcttcaccccctgcgcccctgaccccagactctgagcaatatgtttctgcccctcaccatgtgtctgcactgccatctcttctttctctttgctcttcttgcttcctttcaaatagggagtgagtacaggttcttggttgtagctgttgggctagcatggtggactggccgaaacagaacttcctctgcttatcttaacacgctccttgtgctttctgctttcctccctgaccatagtcccttttctccttccatttttcgtatcttctgctgtcctttctctccctcctctctctagctaaagtaattctatgttaggtaatccatttgtccattgatatataaaataagaaatacttggtttacatttaaatgaaagtattcagcatataagtgtccccaaaaaagaatgatcagcatctttgctaaggaagatccctttttcctacttcacttattgtaggtatgttcttcacatctcctgatggagaagtctccaggcagaagcagggctctttcacagcccctttccccatctaaaacagtagagtcttgtgttagctggtgatttttacctcttaacattttcctagagaggtgcccagaagacctctcctagatgggtggcagttgactgccctgctgggggcctggtgaggcagggcatcctctgagtctacgaccccttctctcccctgtcctgcaggtgcttttcactccagcaacgcaggccgcacggcaggcagcctgtaccattgtggaagctctagccaccattcccagccgcaagcagcaggtcctggacctgcttaccaggtaccatttgggagtgggatgaggagcgtggttagacttgctctagagccttttcatcttccccggggaatccatggatcagggtaatgagaggcacacctctgggtagaagaccccagaaacaacaaagtgttaaaaagctgacttttagtgatggtagtggtggtggtcgttgtggtgagggtgttagcagcagcagcagctaatatttgagatcttatgcagctaatattgatcgagattgagtgcataaatgcttggcatgcattatcttatttaattctctcatagcaatcagtgccaaaatatgaatgcttagattctgtggcattcactccctgcagtgtgctctgaatgcttcctagatgtgggaaattcccatgtgggaattggagctgtcttggatgctgttcctccaccctctaggaagcaggagagacagacagcagaagataggaaagattgggaggagaaaggggagccttggagctgttcgaaatgctagagttcttgactagagtgccctgtccctcttggtggcagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggtatcctaccctattgcccaagagagccccttccctaattcccccttgtaccttgatgtaaactctactatggtgttttgtttgtttgtttttgctgagaagaaatatttgttgaaggtgtttggaaatatttttatgacttcattgtatttattatgtagctgtagcaaactcttgggagcatttggactgtttacagtttttaagcaatcccttaccagcgctgtgactgttggcttcctggaaaggagttctgcaagggttcgattaagaagatgtaactacagagtgtctggtgctgcaagctcctgggacagtggtggaggtaactggtatccttggcagtgatatcacactgactgcacttgtcatcctgtttaggaaatagctcgtctgctggccctggaggaggctaccctgagtaccgatctgcagcagggttatgcccttaaaagtctcacaggtaaagagccacctggaccttcctttagggcatcctgaatctgtttagggacaacccttagttccttgggtgctggggttgactctcttctctctggtactgaccttagtgcagatttaagctctgcattttttttctgtattgatacgtttatgattttgagaccctgtttgctattgactgtttccgcttgttgaacacctgctctgtgccatgcacaaagatagattttccctgctttttgagttgctcataatcttttgagacacagactgtccttatgttttcatccagagctctcacagcaacattttcctgtctccacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtagcactgcccagtggcctggagcctaaggcactgtcccttctggggctgccgaggtgcattcgaccaatttcccccagttccacagatccagaggaggggtggcaaacatctccctgcattcaaagggagactcatttcttgacaaagtgttggctcttggaattttaaattctagagctgggctcagtcactttggatttttcatgttgagcttatagagtggtgcaaggtcaaaggctctctcattggtgtcttctatcagtctggaaaattctcagccattgtctctttaatcccctctgctgtattctctttcttttccttgtgaaactccattttcactctgtcatccatatctctccatctctcataatgttcatctcattgtgtatttatgctgcatttttgacaatttgttcaattcagtttttcttcactgtgtgcaaatgtttaatctacctgttgaattcttgtggttctagattttatggtctcttttttatttttcattttttgagaccaagtttcactcttgttgcccaggctggagtgcagtgacgcgatcttggctcaccgcaacctctgcctccaggattcaagcgattcgcctgcctcagccttactgagtagctgggattacaggcatgcaccaccacgcccagctaattttgtatttttagtagagacgggatttctccattttggtcaggctggtctcgaactcccgaccccagatgatccgcctgcctcggcctcccaaagtgctgggattacaggtgtgaggtctctttttaaaaattcacatttccctcctttatatgatctataagcatattaaacatttgtgtctgataattctaaaatttgagatatttacatgcctgattctgcagtttgttattttggctcttgctgatgataccttaaagtcttgttgtgttttatgagttttgactgtgacctcatattttttagctttatctgtggaaattctttaggactgggccaaagatgggtttctccagaggaggtaaagaactgcttctgtgaggcagtgcagggtactgctgtcccagttctgagcctcaggattttcagacctcctaggtagtgagaggtttgagccgcaaacccctataaggggacagctcattacaagttttcagaggagatttttccctgccacttgatggtaaagtttaaggaaagtcaatttcctcagttatttggttgggggaaagggatagctgatctctgcaccaagggtgtagctctttggggtactagatttgtatttgtggggcatggggttgggggttcctgctagactctttgcctcagtggattcggggctttatccacctctcaaatctgggcagggcatggaaaccaaagctcaacgcaaaaactgactcgtgttttgcttatctccctggcttcccgatttctcttagtttatggcttttggctgttctgtgttagtgtggcagttcactgatggatttttattcaacactttaaattgtttttgagtggtggagagtgaggagtaggtcagggaacctcgtttgccttattgcccaaaatggaactctttctgatgccattttcatcgtgccatactgagctggtttgtgacttcgtcagggacctttacctttttttttaattttaattcagacccacccagtaatgcaacagtgggactttttttttttcccgaagtttcactctgtcacccaggctggggtacagtggtgtgatcgaggctcactgtaacctccgccttctgggctcaaaccatcctcccacctcagcctcctgagtagctgggactataggcgtgtgccaccacgcccagctaattttgtattttttgtagagatggcatttcgccacattgcctagcctggtctccagcttttgagctcaaagtgctcacaagaccttattttttaaagaccatattttctcaccttcatgttactttaagttgtgttttttcgcttatagaggacagtctacctaatcttttagaatgaagctaaaaactaactgtaacttccttttgatttgactggaacacaggattatttgacattttctgagtgcctgttttgggcaaggagatgctagttaaataaggcacagtccctctccttgaggaggttatatcctgagagagagcaagacatgtacacagccaaccatgatgaagtgtgtggacttgggtgttatgggtttcaaactgaatgtggtctgaggataaaatcaatcagcatcaaatttccaatttgaactattgatattgccatgtagggcatttaaagacttaccaggcagaaataatttgtcagtgatggtacttcagttagaattctcatttcaccttccatgggagaggctctttcctaacttggccgctttgatttctggcaggtacagaatcagaaaccaaggccttcatggctgtgtgcattgagacagccaagcgctacaatctggatgactaccggaccccggtgttcatcttcgagaggctctgcagcatcatttatcctgtaagcagtgcggtgcttcccatggctctcgagtgtcagcacagcccactttgccatgaagcctcttggtgattcattaaagttatggggaattgtaccagctgtgggccacttagtcattagtgaaagaagatccaccgccataaaagtgaagcaacctcataattttcctcttgctaacgatgggacatttaatgaccttccttggtcttatttcctagattcaagtaaagaatcatgtttttttaaaaactaggtctaacctccattaccaaaatcccattgcatatcaatccaacatactgtggaagaagcggtattgagcttgaatataaagatatttttactctcttccttctttagctgccctgtattttgtgcacacatgcagcgtgtgtttttttccctagcctgaactgtgtagaagcacagtatcatccagagaacccttcctgctattgaggaaagatgaacactagtatcatgagctagcaatgagagctcattgggggtgtgtacctgagtgtcatgtcccatagagaagcccttttcttgacttcagggtcatcagtgacaaagtcctctggccccaaattggttagcatcacatgagaccagcaggaggaggaaggaaagtccctcctcgcaccccttccccgattttttaatatatctctcatatgtcactccttgtctgcttgttttgttaggctttatctcctaatccaccctggggtttcagggtagatgcttgatattttagtctacttgagtttgtttagatttttggaagtacctctgagtttcctgtcctttgtatctttaaatgtttggggggcttgctgagtttggtgtgttttcctcgagtgtccatggaacaaggtagcatggtataaatctccacctctgccatcccttctgatgcacccttctgtctgtcctccaggaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggaggtaatgaccataggacagtgctgcccacgtttacgattaggggcttcctcctaggctaaccaaatccaggtgcttcttcctagtagctgattaacttggggcaggtggccttcagtttctccactctgtaagttggggttaatgattcccacctttctacctcacctagtgctaaggttaataacctgtaaagggctctgcccagtgcctggcaggaagtaagcatattgttaatggctgttggttgtagtggtggtgggtatttattatcgttattgcctctggcagagacttctcggtgagtctgagttacctgagccccctaaatattggcgttttaccccctgtgcaggtttatgtccccgtgtcagttactttctggcagaccgttgagggtctgacatttttacatagtgaaaagccttttctggtgctgagcctgcaggagaaggtccccggtgggtgtgtctaagctggagcctgtgtgtgggttagggacgttagcagcccctgaaattgtgcacaaaattctgtgtgtttttcatacgtgcggattttttaagagtgggagagttgataggtccatgacatataaaaattgtgaattatcaaccattgccgtaaggtgccctttgctcttggattttacttgtcttacaattatttggaacaacagcttcacctgcttttctgttcagcttctagtgaacaataaaatcattagtttggaccttcctgtggctgaagtttacaagaaagtctggtgtaccacgaatgaggtatgtgcctgctttctcgtttggaggtgtggtttcacttttctgacttatgcagacttgtaccagcaggagccattgttcatcatcacttacctggcttgtagcagctctctaaggctttactgtccctgtttggggttgtgtggagaaaaccaatcttgttttcctttggaggcatctgactaatggagggacatttaatgaccttcatgaagcttcaggaaagcaaaagcattttgctgggctgtgcaagttgtcaaaccccaagaactgaaagccagggggtgtcgaaggaggctctgtgctgggaatgcttgctgtcttgttcccttcagtatggacacctctcagctgagattagttctcagcttttatgggcctgctcgcttagtagaacatttttccagtagctgtgtcaaggagcatcatttctgttttactagttggggaatggaggctcaaacaggcagttattcttgaggaggggaaaagggaaatgaaggaagtccagcgctctgggccttttggccaccacgagtgatgctgtttgtccacttatggaagtattagatggtccccttcacctttccctcctttcttactctctgttccttccattcctctcttcctgtttctttttcttcccctccatttctctctccccctgccatttcttcccttctcttgtttctattgggaggagaggtctttagcacatgaatcagataagtaacttaattacagcaaactagtgtagcagggatgcacagcaaacttttctagacttggtcccaaatacttctgtagagtttgagaaactaaattggcagtatactatttgtagattttgatcttcaatttgttacatatttccgcctctctcctttcttttctcccactgggctgggaatcctgcttactgttgactgttggtctactgccagtggggtcgttgttgcactgttggctgagggacaggcagagaactgtcccagccagtacctcttgttacagacattgtagcatcaaaacagaacaatacagatttaatccctgatgcatataaaaaattaagaccaagcttctgtgggcactctggtaaatggtggtagtgaacccacagaatgcaccagggtatctcccttgaatggtgaagcaagatagaagttgagaatcatttgcccctcacattgatgtgcttaatccagttagaaggttttctggcaaagttctgagtttgtgatagcctatgttctgggacttcagcttcccttctctaccttgccctccatttccctgataagcagcctacctctgtagctactgactagaactagaacctgctctgtgttcagtgtctgtggtggttctctctgaggaattctcactgggcttctatagccggaaacacttctgcaactggcctttctggcaggttgtcttcctccagggtgtcctgtcctgaagctcagcatagacttggaggcaggctgcttgaattagcgtgctaccaaatcccccactggatttcatcagtggttactttgagctccaatttctagtctgcaaaatgagaataatattaatatatgtgctcagtgccagacatacagggaactttccttattctccaatttagtgaagttgctgtaattttgtcatttataaaagacttgattcttatcattctagtcagattgtgggtttagcttaaagaattgtggatgaaccccctccttgtatggttatataaagacgtctgaatctctgtaggtaaagattgatgtactctcttttcctgttttgattcccgaggcttgagtcaaagctctttgatttaaatggccttgtttgtcctgggtagtagtccctattgattggagacagtttctactcctgaggaaggtccaggcttggaattagacctccgcttatagcttggtaaccttgaacaagctgtgtaaccttatgtaaaaggatcatagaaagtacttaattagcataggacctggcacagagtaaaacattcaataaatatttgttagattattacatagtgttctaatgaaattgaaggagatagtgtctttaaaatgtttcatacaatgtctagcttctagtagacacaaaataaaattagcattctttcccctaagtgaattgctgtgcatttggattctagatgttgtggttgagactttgtagaaaaatagaggctctccacattgctggggctttaagcaagaccaagtatggagtcctttgcatttgtctgggcctgtttttaagtacctttctccaactttctctgctcagggagagcccatgaggattgtttatcgtatgcgggggctgctgggcgatgccacagaggagttcattgagtccctggactctactacaggtagatcatggcactgcacattggatctgaggcttgggactcatgagcggctcacgtcccaggacttaggggcattctcagttgcttctctcttgtacctctgcatcagaattgtggggagattgtttcttcaattgaggaaaaaaagaggtgtctgtggcatgatgcagataccactgagtgttcaaaaaaaaaaaaaagaataccagcaaacttttagaggaaaatgcaatgaacagtaaactggagttcagatttatttttaactccctctccccccactccattgatggtattggtgctcatactttgacatttgagtaagtaattttaattgacttgaaactttaaaaaagctcctactgagagtgggacagtttaatatcatccatcattgaccccttttattggccgtgtctttattggagatacggaaaagggctgtcagccatcagccaggaatagggctgtcttatcctggcctattttattcccatcttcaccttaccctccatttctgcttggcttcccttctcccctagatgaagaagaagatgaagaagaagtgtataaaatggctggtgtgatggcccagtgtgggggcctggaatgcatgcttaacagactcgcagggatcagagatttcaagcagggacgccaccttctaacagtgagttgggggcagcaagttgtgggggccagcctttctgcactgggagaggcccctgtggaaagaagctatggccactgtgtcattttaccctagagggcagcatggtgccgtggagcagtgcgagccagtgaaggacctggcagttaggactacattcttaggcacaccttttcccgtcctgctggcccacttcccttctccaatacctctctatagagccagcatctgactgtctttccccaaatagctgcacttgtgttaactattatcattgttgttgtttttaaaatggattttgtaatgtaactcatttcttgcattgtagggttttgtttgggtattcatccaactaatctccttagtgaggattagagcattccagagaggcaccacaaatactacactgttattttcactactccccacccccactcccccagggtttatgagaatatgtattattgttattattgtgcctttgttttaaatgacctatgtggttctgagctctcacaggccacgagctttgggatcattttctttactattagtttagggtctgagttgatgctgggatttcccccaagacaacaaacagagcatcacctcttccattaggaactgctgtcattgccgttgtattagagatggtagagatatatcccgccattggagctaccagcctaatgtgagagcccagccatctcaccatgtcccctgaagagccgcttctccctcctgtcctcttcatttcaggaggagcccctgctgatggtgtagaccctgcttagacatccctttcctactggcccccatgtcctacactctcatgtggcctcatgggttttgactggcttttcttgtcaggtgctactgaaattgttcagttactgcgtgaaggtgaaagtcaaccggcagcaactggtcaaactggaaatgaacaccttgaacgtcatgctggggaccctaaacctggtaaggagcatggactgcaggtgaagaagagtgggccttggaagtctgggtgtgaaagacctctcagttctgggctcagatgaaatggactcacggcttcttcaagcccttcatctctctggctgactggtgcagaggcttgggtcattcagctgcccttctcctctggctggctcacctcctgcccccatgctgctgccatggcactcaagagcttccttgctcctttcctgagttcagatcagagataagaggaaggcagtcccttaaacagtctagactacacaccagtgggaaagaagtgcccctctccttggggcagcaaagctgcctgtcatcaaaagctcacacgcttgtctccctctcagaacatgcatatacacgcacatacatacacacggtcatacacacatggtctctggggagtaaggctgtgagggcatccttgagagcaattgtcctcagcagttagtggctgtggtcttattctgagagtgactgagtctccttctcctacaggcccttgtagctgaacaagaaagcaaggacagtgggggtgcagctgtggctgagcaggtgcttagcatcatggagatcattctagatgagtccaatgctgagcccctgagtgaggacaaggtgagtggggctcggcccctccatctgcaggcactgagagcctgcactgtctcattgcccacaacaggcctgtttgtgtctggcttagcccacctgagaatggcggagcctgcttaagcattggaatgttaggactcaactaatgatgacataattgtatcgaaatgtgaaatctttggattcagagcaagcacaattgctaaggatagtctttcactcaaaagctgctcgttaatggaatcctggcatgtctcagttgatagacagaggctttagtccaacctttcatttcatagttgaggaattgaatagcccacttcatttccctggacttggcatttcctcagctgtggtacatagttggttactggtggaatcaggcctagaacccagatctccaactcccagaatttctctccacctgctatgcctgtaatttcctccattcttattggtgctaatgatttggctagagctatgaccaagtgaatgtccagcagcctgcattcttttacagggagggaagattgtattggtatattttgaccacctgagacaattaacagcactgtcacagaaatttagaaacgaatttctcaagtgaaactccgactgtttgttattccccaagaagtgccgagacatagttcttctaggggtattcctgatgactctgatggaagtggtgacttttggggctcagatgttggctgcagccacagtcctgactgcattaatggcatgttcaccctcttttctgttgcagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataagtatgttactttgatttcatatagtgaaatgagagtctccactaaaacgccgaactaggtctgtgagatgaggaagaatcctctgaatacctattagatttttgtgtcctcgttctggcttttaaggagctcagtctagttgggaagtgaatagttaaaatatactgtattagagtagcaattggctagtcagagaaggcaaagtggttggtgagatgggaggaatatgacgagatggagccacgtgtgcgcaaatgtgagtgcaagagaaggctgtgagcgtgggagacatagcaggtaaacagggagagtggcaggagccggggcagataggtctttgtgtcacgttagggaatttagccttgatcttctataggctgttgacagttgttaaccaagagggtgacatgactgggttttgtcccgcctttcacaccctcaaactctgctctttcctcctagatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaagtatgaagccctcccgcagcggggctgctttgccttcgctttgccctttccttttccttctccatcagcatcttggcataaagcttcacgtgtgccccttgccctccttggggcctcccaaccgcttctggaaactatgtgggtgaccattcaaccactgcagagtcctcggggcttgccggaaaaggatggcaactttttggtttctacttagagtactcacttctttctggcttttcagctgagctgggtggttctatgtgattctttatgacactcggagagggtcacggttaatcatgccctgggggtttaaacaagccagagtcaacaactggtttctaggtagcctttgcttccctggcctgctaataagccttcctttgctttgcagtttggatgccgacatctggaaaaagtttttgtctcgcccagccttgccatttatcctaaggctgcttcggggcctggccatccagcaccctggcacccaggtgggtagccaggacaggtagtgtgagggtacaggggtacaagtataactaccctagtttaccttgagacatgacttaccctaatatatgagacttctagagtagaagtgagcctcagaagtcatctacttcatctatgtgtgctgagagaagtaagttgtatttgtgatttcctcattcaactcattcttaagtggggcttcattgtctaatgggtcacctgtgcaactgttgaactgtgagggattggctgaccagagagtaaaacacttgggtgtctggccacagtcactaggacacttatattaccatcacctctatcttctctgcctcaagcagctgaaccccttgttcttagggagtcccacccattccactccgcagctcattcctgatttctccccacagggctgagcgttaacccctcacaaatccaatcctaactggccctggatagatggccagggctgggttttttttttaaatcaaagttttaatttggagattattataaattcacatgcagttgttaagaaacaatacagagaaatcatgtgggtcctttccccactctcccccagtggtaacatcatgtggaacccgagcacacaccacaaccaggatatagacatcagtgccatcaggacgcagggcaggttcatcagcacaagggtccctcttgttggccttttgtagccacatctatcttcccctgctcccctgccacaagcccctggcacccaccgatgtgttctccatttctgtaactttggcatttcaagaatgttgtataaatgcagttgtacagaatgtaaccttttgggattgtcttttttttttttctcagcatgattttctggagtttcatccaggtttgtttaactgttcacccattaaaggacacctggattgttgccagtttttggctgttatttataaagctgccatgaacacttgtgtgcaggtttttgtgtgaatataagttttcatttttctgggataaatgcccaagagtgcagttgctgcgttgtatagtagttgcatattttgtttataagaagctgccaaactgttctctagagtagctacagcattttacattttacatttcaccggaaatgtatggctgctccagtttctctgcgtcttagccagcatttggtgactatttttagtttgaactgtttggaagatgtgcagtgattccgtgtggttctgcgttttcctagtggttcatgatgttgaacgtcttttcatgtgccctgtgtatcttcagtgaaatgtctgttcatgtcttttgcccaatttctaactggattgtttgttttttaatgttgagttttgagagtcctcagcattgcgttttttctgtttgtagtgttctgcattgaaaatagttccactgtctcatttggtaatctgtttcggtaactcattccaaaaacatggtaacttgagtacagtaaagattcttcactgtgtctcactgaaatcccttttctaaacttctgttcaactcagtggagtcataattgtatatatttgtggagatactttttcctgcataggaatttcacatgtattgttttccatatccttgtaacatctctcttttgtatatggataaatcaaggaacacggttgtgatttggccaaaggcaacacaatgagtttggaactcaaagtcagctgatttccaggcttattcttttttttttttttgagatgaagttttgctcttgtcacccaggctggagtgcagtggcatggtctcggctcactgcaacctctgcctcccgggttcaagcgattctcctgtctcagcctcccgagtagctggaactaaaggcacctgccaccacacctggccaattttttgtatttttagtagactcggggtttcaccatgttggccaggctggtctccaactcctgacctcaggtgatccgctcccctcagcctcccaaagtgctgggattacagacgtgagccattgtgtctggccatccagatttattcttagttaccaaattgaattactttctttagaataaggctttatctagttagatacttggcatttatgctatggccattcatttttcttgcaacacatcttgttgtgtagctggtcctgtgttagactgaggagacagctgtcgcctgtgcctgttgggagcttactgtctggtggaagatagagccaaatacagagtagtaactaaacagcgagatagatgcagtgtggaaggggcctcaggaaataggattgttaagtagagggcatggcacctgcaaaggttcagaggccaaagagagcttaaagccttccaagaattgaaagcagctgcagtcggaggcgaggcatggcaagagctgccgatggagatccaagcaggggaaaggcatgttctttctcccagaagaggagtgtgggttttctcctgagggcagtgccctggccatattacagagagtgaattgaagggaggtgagattggaggtaggaagaacagttgacaggcttttatcgtaattgaagtgagagaaatggcagcttaaactagttcatggatagattcaacagagattgagctgggaggaagaataaatgggatttggagagtgaccgaacgtgagaagctaagaagctgaatgaatcaagaacctgctcagtttctggaatgagtgatgaggtgaatggtggtgccactgagatggagaagatcagaggtttgcgagtaaggtggaggagagttcattagactatgctatgaatgtatggtctgtcctattaataactagaatgtaagttaaatgagagcaaggtctttgttttcccagcaccgaaaacacacatgtgcaagcatgcacacacagtaaacagccagaatgttgagtttggggtacctgtggaaaagctcagtaggagttgaaatatgggctcagcatttaggagcatgagacatgagggaataggtaatttcgctgagacacagattggaagtggacttgctgtgagaacagatttatgagctactgagtgatctgctggctgtgttattttcagcctgttgtctcatatgtaatcattgctgtcaagtcacttgtgacaggttggtgaggatttcagggatgtggtaatatttctcagtgagctcacctggagtgctttttccaactacacctgtctttagccttctgatgttctccacccccgtttatcacatagcgctatacgtagtgacttccagctttttcaggcacagaggtttcttgttaatatcttttttgttgttaaagtttttcatgtccatacctgcttgtagtcattgcacctctagtatccctagcctgagaaaactgtgctcctaggtttggtggacccaggggctcccgtggagaactcagggcaggtccttaggagaacgtccagtgcctgctctggctgctggttcaccactcagtacacatcaggtgttgctgcttgtcttaccagaatacggggatcttctcctggcccctttccacatcctctgtgatggatgctttgcatatgttatctagtttttagtcatcacagcagcccttgcactatccccattttatagatggaaatactgagcttagagcataggaattggtcagaggcagtggcagagccaaaccctcttccatttgtctgtgtctgtcaaagtgtggaatcaaaggacctgattgcagctgagcaggtgacatgagatggtgcatgctggttgagtttctaaacctttaagctcccgggaagaaggtttgtctacataattggaggcatgtgtctctctggtctcttactggcaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacggtaaagctaccacctagagtccccatatttctgcccacactgttgatgaggaggtggccatgggacagccctggggttggccatggggaaagagaaggctggacagagtaggaggaaggaactaggtgtgttcggccctctcagaggtggaactactatcgttctatcatacagatgagactcggagtaagtgacttacgaagtttaccaaaacagtaaaccagtgataatagccattaagtttattgaggacttatttaagccctcaagtagttctaggaggttgatattgttatacccattttccagatgaagtaactgaaactgagaggtgaagtaaataggccaaggcacataactaataagtggttgacacaaagggttctgtgctcttctaactgtcccaccttggaggaagcagagtcctacaagctccttttccaaagcacagacttgagtgtcagcagttgaaaagctcacctgggaacagtgaatgaatcatagtgcaacaacccttggaagctgagacttggcattgctggcacgaagatgctggcatgaagaaagggggcttttctgatggcaggtggcaccttgccagggctccagctggatgacttcctttgcttcagtggttcctgtaggaagagagaatagcagaagggcctgggtctttatccttattagaagacagctcaagggctttcctctcatgcacctgtccttttagtggaggtagaaggttagccctgttcctgagcatctccaagctagggtgggagagggtgtgtggaaatccccttgacatgccaccggggttcccctacagacaaatgaaaagggccaggtcgtgaccaagacagcactcctgaagcagatggaagagctgatcgaggagcctggcctcacgtgctgcatctgcagggagggatacaagttccaggtacagctgctgggcctacggtcggtcctgagggcccagcctgaccccttgttctaggtagcatccccctcctccaggccattttgttcttagctaggcaagatcaaggcctgcatcttaggagattaacaaaaggaccagctgtcctctttagaggcaggaaggcgagctcatccgaactttagactttgttatctttatcatcatcatgacaaatgctgctcattggattcttcctatatgtgaggcctcatgctcagagctttgtgtaaactggataattttatttaaacctgtaaaaagtctcaacttgtggttaagcaaacaaaggtcacatggcagagccagaattccagcctaggcttctcagactccagacctgggcttttaaaaacataccatgctgcctccattcagggtaactggggagaaaatcagaactttctaggcttatccaaactagattccacctgaaaggagcagagcagccagtgacctgctggctctcctgaaggctcaaaggtggcctcttctttccagctggaacttactgcttagaatacaggctgtgaaagggcaggtgcctgggccacagggctcgttagtcctgcgtaatgcaggctcttcagagctgcccagcaggttttgaaaagcaagggaatatcaagaagtcacttctgcattttcagacagatgaagcacaaagtaaagaaagatggccgaggcttgcttatgtgtatgcctctgcatctgcaccgcatccccttcttgctggttgctcccataatccttgtttcactagggctgcggccagccaagtgcttcaccaacagactgaggggctggccttacctgctcttctgaacttccctagtgagagcaacctgaaacccaaggcattgcccaagaagggcggcagttcccctctattctgcttctcctgagcctgacttggagtttctcctcccctctccttatgttgtcgtctttgcagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggtaggccctggctcttgcggaatggctccttcagtaggcctgcctgtgggcctggagcgggtgggactgccatcctcgtggttttaaatctgctccttagtctctggagagtagggtgttctgcctgacaccatataggtccccaagcagttatttgaatgataggaaaatatgctttggcctgggcccaaggctagtgagaacagccctgcctacctgagtcagcaaagccagtgtgtaccacattgaggctacaaatagcaaattctcttcgcagggtcaggagcctgggccgactgacttcttagtgttggcatgcccccacccccacccccgcccccccgcccaggtgcctggttgccacgttaatgccagcagtcgcttgtccctgctctcctccctatccaggttggctcgaggccgggaagagtgggagagtgccgccctgcagaatgccaacaccaagtgcaacgggctccttccggtctggggacctcatgtccctgaatcagcttttgccacttgcttggcaaggtgagtgttgagtatttttcatggtggaatggaggggatttgcaggggatgggacaagacccgctatcagcccaatcccctggtgacaccatttcctgttaccttccttgggaatccatgtctgtctgcttgctgactggggagctgtccagagcatacagggtgggggatggaggcttactcaaggggtgacctgacatggcccaccacagggtgggaggaaccagcacccttagcttccagggtaccagatgaaatttctgggtcttcactattcctttgctgatcttatgacagaagatgtggggccaacttggtccttgaggccagaatttctgagttcacttctacagtgtgtggctctgaggtttaaatacgaaagtggcttagtggcaggggggatgttgggctccttagaaggccttcctggtcctaaaaacccagataagaatagctaaagcatctgtgaggtcctcatgtcttgctgatgccttgtggagtggtgccccaccccaagtcctatttcaaagctcagggataaaaagatgcctgtcataaaacaggcagctggcagtgacaatggagagcatgttgaaatgcttaacctctattcttttgttttgagacagggttttgctcttgtcacccaggctggagtgcagtggcgtgatcttggctcactgcagcctccgcctcccaggttaaagcgattctcccgcctcagcctcccaagtagctggaattacaggtgcctgccaccatgcccagctaatttttgtatttttagtagagacggggttttgccatgttggccaggctggtctggaactcctgacctcaggtgatccacctgcctcggcctctcaaagtgctgggattacacgtgtgagccactgtgcccggccaggcatgtattcttgtatacattgtacagatgagatgcagagtttgagcaacttgctcgaggtcacccagttaataagaggcacagcccagatagatgggaatgtgtattgacataggaaaaacaaaagcaaaaacaaaaaacccttttatttggagattgaagagctcattcttatggacaggtcactttgtcagtcagaatggatgagttctacattgcttcctccaaaatgtactccacatgcagccacggtatgtcctacaacattagttcattaagaaatgggcgcccaagagtggtgggctctcatcaaaacttggcgagtgtcacgttcagtcactgcagaaatgaaaacgtcctatggccttgtcgtcctgctggccccagccttggcctcaactttcccttgtattcttgtctccgtttgcaaacctttgcagccatcaggcctgggagtactggaaggaggctctgtctcccaaactgggttttcaccaggaactcacttccatttcattgtttgttctgcttccctctagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacgtcagtaccctgtgtcccaggggcggcatctcgcagacccaccctgcatccctctgcccgagatcccctcagctttttcatagcctctcatgctagttccggagcaagcgtctggcctaaggcagcctttttgccgaggtggggatgctcatctgcattcttttagggccatgcagaaaaagcaataaagggaacttccttcccccaaactgccctgtctcccaccatgggcagcccaagaccgcatccttggactgacgttcagctcacaggggagcaggaagtgggaaaagtcaggccactgaagcctctacttcgatgcagcggctacttctactttccagactgttctcttgaatggggggaggccacaggtcggagctgtgcccacatcattagtcaagggcatatagattgttacaggtgatggtttcccatcaaggggatgcagcagagctgaggacccagttcataaatggaaaactggatttgttatccctgttttctctacagtgggtaatgcttctggcaagtgtgaagggaaagggaatgttcaagattatctgggaaagtcaaccgacaaggaaggcagccaggaaaaaaaagagattggtagttttatccatatgcacattatgggacagttaggttggtacctggaagtgtaattttaaagaagcacttaggccaggcacggtggctcacgcctgtcatcccagcacttgggaggccaaggtaagaggattgcttgagcccagcctaagcaacatagcaagactctgtcttaatgaaaaaaacaattgttttaaattagccaggctcacacctgtagtcccagctattcgggagactgaggtgagaggatggcttgagccaaggaggttgaggctgcagtgagtcgtgatcacaccactgcactccagcctgtgtgacagagcaagaccatgtctcaaagaaaaaaaaattaggagattgactatcctttagctcttccatttaattcactgtttcatgcttgtaggccccatctcctagcaagaggcttacggttccctgttgaaaggttgtgtacagctcaccccgggtagctgcagcacagtttaggcaacaggacaatctgtctcttgtcttttctagttctttctcttcaacaatgttatcttttccttccctcccatttccttgtgagttaaaaggctgacctcgagaccacaggcttcattgttaaaacacgcaggggcaggttgacatcagagtgcattacatcatctgctgaactgcttagactggcgggagcagcacctggcagcactgatggcgcagaccttcccactgtccaaatttcgctccttctcagtgttcctggggccctggacagagccctgggtgactaggtgtcagtatgtttctgaacaagccagacatttgtaattgtcaggtcccttcattggaaagggaattggctgtctcacagtttctttggtcagccagaggctgacccagaagcttcacagagaggccttgcttctcggcccagactgcttcccagtcgacagctatccaattgacattggtgggagcttggtcacagtggggctgagtgcctttggtggaatatttgtttatggaggcaagtatgtcacagcatggccaccgtaagccagaccagagcctgagcagatcctgcagcagccaacagcctcagattccctacagggctggaagatcaagttgaatgtatccatccatgcccatctgcaggcagcagaagcaggcagggtgtccttgcaccctctcctcctgctttcccagagtccagcatctgtgccagtgccacctatagacctggtaacttttttttcccggttctagtgttgtgtttgtccccacctctccctaccagtgccccatggagttaggatagggcatcaagcattcatggcatgagagcaccattcaggatctaaggagagagtgtacccagaagcgtgtcatcaggaaggacttaagtcacctctcagtgctgattccgtgaccttttgtcaaagcttcagcgtggagaaggaggtagggttaagatggacaggctacctggcttcagaacacagttttttccacgatgtgagacttgggcagaatccttacctcctctgtactgcagttttctgtttctttaaaattgggatagtggtggcactatcccatagcattcttgtgagtactaagtgaaataatcccgtaaagcacttagagcagtgcctggcactgagtctggtgtggtcatcatcatcatcatcattgcaacttaggacgcatgaggacaagaagcagcgctcatctggaagaggctgttctaacgaaggcgggaggatcctagatcagaagaagacaaaccggaagagggagcctaggaaaggaaccacatgcacatttagtgcaaaccatgtaaacataacataacaagactatgtggagcaagggggagtcaggctgtggacccaccagggaatcttgattcatgtttttggccccatcactcactagcttgctgactttgggcaagtcacttcacttttctgggcctctggagttactagcacagttccatgttggggagattgtgaacgtccctgatatatggtgctcaggaaccagtagttgcttggaattgtattagagctggggtaggagctagacatggggccagggaagaagggaagatgccgcgaagaagggcctggaaggggacgaagggcgtggattatcagaggaagtgggagtagtcggcaaggatgggtggggagtgttgagtcatccaagcgttcagcaaatgtcacaagacaacgacaaattgagcaaattcttcctgctcttgctgccgggtcctgcttccaccctgcttttattttatcatgccgcttttcttctagaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggtcagtacctgcttccggaagctgctgctcactatttcccatcatcagttttgaaaagctgcttagtggtacgcacgtgctaggtgaaggcatgctttgtgactgcggtggttgacaccagcccttctcccttctcagtctgtcatgtcaagagtctaagctgatggctggcaggttgcctggtcatttctgggttttctgttccgctactagaaaggtagagccagtcttacctactgtagaaaatgttaggaaggcagccaggcacagggtgataaaaccaatgagatgatcagggctaagaacagtaatcaggttttccacatcttgctggtgttggcataagccaggaaagtttcagtgtggccacatggggtattttctaataattaaaaactcgtcttcattctctcttcttggttacattcctatcccatgcgtcccacattccatgaacctttcttcctctagaccactctcctatacgtgtggacacctccccaagaaagagcatgtcagaaaggaagtggtctttgatttatgaccttgggctgtgatttgggacagatggtctcaagagaaacagctggaaactgccaccacagcatctctttgaggacccccatggattgctgtgcgcagaggagaccccatgggtaccactcaggctgccaatggccccacacagtctctacctttcctggggagctacggagcaggctctgggtttggcattttgcttctgtccctcgagtgaaatgtgcctctgcttcatttctggaagatcgggtttgtgatttttgtgattctgctttagcccaggattcgagggatcatgtccacatttgtaggccatccagggagcagagagaaacttttagggccgtgataaagacaagccaagtggaaaatagcctgtgccctcattggcacacctggtgtctttatttccattagccctgattgatcaagcgttgctggtctgtgggcacttcacgctcccagagagaccagattggagctgtcctgttgaatctggcctgtaccagatcatcactggagagtgggagggggcgtcttgttagattcctaggtaacccctgcccccattcctaacatatcactttccagtatttcccaagagcctgaattaatagttaactagctgctggaaatcaaaagttagatcttgagaatactaagttgataagtcaggcttggccagtatccatatgctgcatccacagcaaatagagtggccatttattgggcacagtctctccatggcgggtgtgcaatctgaacccacaggagctgttttgctctcacttaggagactagcattcattattgtcccaggcagttcaggaaaagctgatttggtcacagcttaattaggaaatccagtgtgagctactacattcatgagttgctgttttctctgtagcagtttcgtcacctttactaattggccttaaataattaagttgggcagggtcactcaggatttctgcttaccaaagcacaacagccacagcaaagggccaaatacggccgtggtccggggccgtgagcccggcactcatcaggcagactaggaaaggcactgtgggttagcccgatactgggaggagacccatgggggagagaccgcggctggaagggcgtgtagagatatcatcctgatgctggggcagcctcactggcggcaggctttgtcctaagtcctgtaagtcatggggtaaggggtagtagcagagacacagaaatgtagctcagcagaagctggcctcttctgcacacttgacattcagaaaaaaagttcctctgccaggaacttgcaagtacaaagcctgggacattctcaggcgtctgtcagaacttgatctgttatcttgtctgccagggtaaagagctgcagagaaatggattcttgtcctcatccacgggtccaccttccaggactttaggctgcagcatcatcacacgtatgcgggagagaaagtgggggcttgggaaggtactggggcagagggaggccacaggaagcatatttcagtagagagggaattgtccccatttaatattatttgttttttgcgagttatttattgaatgcaggtgtggatagcctgtctcatgctaggcagccccttcacttgaggcccatatagttttagcttctataatgaataccatctatgtttcttatttttatgattcttatatatacccatgcattttaatactaaacattttaatatatgtccctttagtcatgggatgtgttccagtgtgttttgaggtgtagaatactctgtgacaagggctcacctaggctttacttattacagatgtgatggctgttggcaaacaaaacctccgtagagcttgggtggtagaaactgaatcctgacactgatatttcactgtctgtgccgaggggagcctgatatttctgtgtttcatactggctctacctggtgtaatcattcctcaaacctcaaaccaagaattctgctgagaaggcagtggacattgttagaggcagtctccccctgcctgtcgctccccatattccaaggaactggctggtctttaatcctgaactgaatcattggattaagtagcaacgatactggttagaaacaatggggtgtggtgagcaacttggattatcccaggatttaggtgatgtcagggtggctgcatgctccatcttagacattaccattgcttgataccaacttcctagcagcttgctgccatttaacacagcacatgtttgacaagttaccgtgtttgactggtttaggtctgctggcttttaagaaatttctcctagtgggaatgtaaagactgaattaaaaccttgtttcctacctcatttattaggttccatcaaattccaagagcttgtcggggcccaaacacaagggatacataggaatcctttgcctttctttaagtcactagccttgcatttgccacgtctgccctggcgatgtctcccccggttccattttaccctgatctggaagatgagcactgagagaatcagatgaatttcatggagcatttttgtaaccaataaacttctgggtcccagggctccagaggttcttgcccacagctgcttttttccaagcagaaggctagtcgctggaactccgagatgcatacaccactgtgactcttcccttgctcccagcatgccttgctctgtccttgtgagtatcctcctagggacttcatgtgatggaactggattttcttttccaggctgacagataaggcagtgaaggactattccgcttaccgttcttcccttctcttttgggccctcgtcgatctcatttacaacatgtttaaggtaaggaggctgtcagaggcccagtgggttttggcaagagtgtaaaatgtctgcactcctgtccctgactctgcctcagcacccacatggctgctcctccgctgggcctgggggcgcttttttcctagaaacaaacaaccccaactgtgggagggattgacactggcagcctggagccttgtgtctgtgaggtacatttgttttgtttggttttgtttggtttggtttggtttggtttttttgagacggagttttgttcttgttgcccaggctggagtgcaatggcgtgatctcggctcactgcaacctctgcatcccgggttcaagtgattctcctgcctcagcctcccaagtagctgggattacaggcaggcaccaccacgcccggctaattttgtttttttagtagagatgaggtttaaccatgttggtcaggctggtctgaaactcctgacctcaggtgatccgcctgccttggcctcccaaagtgctgctattacaggcatgggccactgtgcctggcccacatttgtagctgagatcactcctgtcacctgctcccgagcctgctccagactcggctgtgcaggaagaccttccccgccgggtctctctttgctgctcttgccgtgctattgggataagctctgttgccctgagtgagtctgacttaccgcagccagcttataacaggacactcctctccggagagaatctgagtttttgagttggttcctttcatcatcggaatgagacagctcatggaagcacattgacaagtccctttgctctggggaatgcgaatgggaagtgtacggggagggaatgcagccacttgttggagcctgtagcttcaggtgacacagtgcctaataaggagggcctaagaggaatgaagtgaaattgtgtcgttcctggagacaaaacgcacgctctagggtgcctgttggtatgctttggtgtaggttgggagggctgtcctttgaggggttgaaatggcctgactgacttgaggcggaagatgaggcagcagtaagtcacccacctctcttgtctcctgttgattctcgtagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggttagtgtcaaggttttctcttttaaagatcctccgcagcaaagccccatgtcttcctccgtgggtcatccgtagctttatcttcacgaccagaggaaacgcagtatgaaccagcctgtcagctgccactgaaagccctgggaaagatgcgtaaatagcaagtcaccgataacgagaacagcagctctaacatgtactgagcaccccctctttccccgacatgggctgttcactgtatgtgatctcagccctcgaggcagccctatatgaggcaggagctttggttatccccattttatagatggggtaaatgaggctctgaagatcaaataagtggccaagggaacatagctagaaagtgatagcatccctgtttgagtctgttttttaatggcagttcagagaattaacatgcaaattggaatgcccctgtcttcctcctgcgtcttaggtcacagttgaccccagggaggcatgggcgacccagcagggccgctctgaactgtgggtgtgggagacgtggtcagacaattccttatcctactgctagtaaaattgaaattctttgtgtaacaaatttgtcattctaattgcaaacaaacacattagaattggtttgtatttcataaccaagcaccaagtgacagcagggggaggtgacttggcccgtgcctgggaaatccacctagggttaaaagacagtgccctgtgaggttgtgggcgccgcggcattacagcccccatcagagcacccgccctacaaaggtcagctccccagagccaacgcacaggtaaccaaacctgccagctcttttttatgatcttgtttcatttttttatggcattcgttgtgggaattttgtaaagtataaagaagcaggaaaacaaactccccccagatcccactgttaggagaacgcctctgctaacattttctctatcttgttatcctctgggaatgagacccactaaagggctagagtgttgctcagtgtgaattcctctttcttcccagctcagagccagctgaccgattttcccaaacagctctgtgcctccgcattggctgccccttgcagtgtcctcagcggaagctctgtgctgggatggtcttcgtcgacctggtgcctgcctccgcgtctgggcgggcctgtgctaacactgctcacctctgtgtgtttgttaactccaccacctctttacggctcccactggctctgtttcagcctagatgtttcaccagcatcataccttagcacatgcctcgcgttcttcccagaaagtcagccctgggaccaggtgggctggtaaagtcctcagtgctgggccctgtgcctgttgcatgagcctgtgtcactgtgactgtggaagttggagctagtgagaggaggaggaggtgggcagaggaaggagggtcccttgggctcgagctccacatcagccctgagctgctggcaagcacccctggcctgcagccagggagagccagagcctttgccaggcagcgagcctccgtgccttccactcctaggtcaggttttgacagcaccactttattactttgtttaagctgttagaaaatttcagaacatcagacacaccctattcaaatgtgagaacaaaaacaccttccagcagtgcctgcttctggaacaggactcctcctgcggaacagggttttgctcaatgactacctccccggtcatgctgctgtccagtgagcagccgggccagagcttgtcggaccgcagtgtgttctctgctagatgcggcagctgtgactcagggggaatgggggctgtatgcctgctcctgacacacctctgcccgttgtgctttgcaggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaggaa

SEQ ID NO: 15178 - DNA, 7575 bp, Homo sapiens
gacttacgctttggcctgcaggatgtctccaagaagaatgagcgcagcgccctgaatgaagtccatctggtagtaatgagactcctgagtgtcttcatgtcccgcaccaaatctggatccaagtcttccatatgtgaggtatttttgctttgggttcatgggtttggggaaaggtaagcggattgtctgggtagtgctagggccagcacagaggtggtagtcctctgtaagaataaagccattgttccctgaggggagtaagattctaagctgtcaccttttcaagagcagaacctccaccttttcccgaatcccttccaagctctggtctttggtaacaatccctccaatggaggggtaaaagggtttggaagttccattattgaagagcagggctctcttctgcaaggcacagagtggctaagaggattcccctagtgtatgttgctataaggtatggtaataaagcagagagaaagcaatgtgtgtgtggtgaaaggagattagcataaagcagagaaggtagaaattgaggctgaactgcatccaatcttaatgagcttagggagctgtggggtttgctgggatttgcaaggctcttctaatggtcttatttacagtagcttttctccttttttatgcatgtgatcactcacccccaactcctttggaagctggttctatggaagactctacagggggtggggtggggtcgttcagaagtgcctataatggaaagttttctctctccttcttgaattgggcttcttttctagttgctcaagataaaagaggaaacgcgtcccctccagggggaaaggttatttaatccttgcctccctggcttctggcatatgtgcgtgtagcaaggttagagttgagaacagatgtgtttctttgtttgtcttaccatgtggttgttcaaaaaagttctgaaaaacctcacaaacttccttggggaagtttcagtgcaagagcctgattcactcactgccataaaagctaagactgttgtgagtgtgtttcccatccccaacacccacctggatttcacattgtttttacaagccattcttcccatctctgtattttctctgtctcccagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaaggtgagatctttccctcatcaaagaaacactcgtcctttgttcagagcactcttctctttcctcgcggtgcagagagctcaaggggctgagggtgaagagccataggaaggagccggcattccttggtgggggttaatctcggcgtgattgaataaatgaccacttctcccaaccttctgtgggattctcattcctgcctctttgtaaattggaggaattgaatgagatcatggttatctcgtttcacattaagtttagaaaaagatgagaaggtacaagctaatgtcatgagttgtgggtcatgacatgtgtgtcagatattccctgtgctgtcaccactgagaggccctttaacgtacttattaagaagatgggccttctgatcagattgatctgggataagtcccatcttgtgttcttacttaccagtcttgaagcatggagaagttctgtctgtctaacctccctaaccttcagcttctacagctggaaaatgagcatacagatggtatctgctttacagggctgttgtgagcattgaatgaggtgccctttgtaaaggacttagcacaatgcctagcatgtatcaatgcccagtccgtattaactgatatcaccagtctcttcctcactgccccctcagaatagctttgagtagggtaggaatacgataggcatagagtgtggatctgatcgttgtcttgctcttttttcatgactctttggtggttttccataacttacaggccaaagagttctggaggacccagccacctgcttgactctagctttgtcacctataacaccctacacgcagccctgccagcctgcacatttcccaaggtgtggcgtgttgcctttgttcatgctgtcccttctggaattctttcctctccctctgctcccctttcttctcctgtctagcgaattcctagcccatcttcaagatccagcacgagctttggatccttgggaaaacttccctaacatatactccctgccatcaagtctgctcaagagagccttgtcctgggttcccggagcaccctgtgtgctccttcacctgtcttcccctctacactctcagcagaaaccatattttattcctgtttacaactccagtgcttgatacagaactgatgaataactgggagttgaatatgtgagacacgttgtgccctcaaactcttacagattctttttatgggaccacacagcttgcaggatagctgttgtttccactgtcctcacatctctcatttacctctgcctttttgtgttacatgaagccaggaatcttggctgagtttagtgatcttgcccaccttggtttatttaacaatttcttgttatcatgggaaattttggttctagggatagaatacatctcatagaagtcagagatccttactccctttttcttttttttttccaatttttttggcctttctagcactcatctttatgtaggcagagtacaatcaacccaatgtcaaaaaccatagagtgaaatattaggacttttaggaagtgaggtctgcctccactgtaacctttgcatgtaattaaattggccgcagaagcctgggccttctgggtttatagaataaactgtcagtcagtcttgattccagctctgaaaggcaccctttaccacctccaacatgtaatacgtctaatgagccaggctttttcctaattgtggtcatggaaaatcgatagtcacaggttctcatgcaaattttcttctcccagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgaggtaagtgaaagtcccaagctgcatgcttgttgggctgaggacacatctgcattcacctctgtgggcccctttcttcctcatccttacttggtatttccccttgcagagtccctttcacctttgtaggtcttggtcttgcccttctggaacatactgtgtggtagaactgtgggagatgtgtatcaaacaagccatactttaccttctgattctgtgtgttgaacttcgcctcacgtgctgataatgggcaagtttaataatttaggttctgtcagaaaaacaaagtatactagttatcttaatagagagatttcaatatgggaaattgggtaaatgctgttggacaacaaaaaagataaaaaggaaacatgaggtaacacagggatagtaactgcctgaagcagttatcaggaagtgggttccctgaggggatgtgatgcggttgatgctgggagcagtgagagaagctgatgattagaactcactgtggctgccagggtgcagggctgttgctaggactgcaggcagatgggaagaagcaagccccttcttcctcctgctgccagtgtccctccctgttggcagaacctaagagggagccagctggcaaagaagtagtgcattggcataattctggcctcagcatcactgggcagtgtcagtaggggtgggttgggaactgagagacaatggctttaataaccttagtaaccagacagcaaccctgagatagattaactctgggaagaataatctgttagcaaacctcagatgaggattttgagttacatagttgtaccaacccaatcttctctttagctcttttacctgaaaaagagatttggaatggtttttttcttgatagtttccctttgggtgggctgaagtggagtccagcttgcctgtagattcctaagggcacaaggaagagatgcatgaatattggtattttcctctttgatttctttctctccctttctttctcctggtctcattaaaggatatttaagtttaagagaggctggtttggtcaagaggaaatagcttggtttgtgtttctccccagcctttgtttttttttttttttttaagaccaagtctcactctgttgacccaggttggagtgcagtgacacgatctctgctcactgcaacctccgccctctgggttcaagcaattcttctgcctcagcctccctagtagctgggattacaggcagtgctaccacggccagctaatttttgtattgttggtagagatggggtttcaccatgttggccaggctggtctcaaattcctgacctcaagtgatcagcccacctcggcattccaaagtgctgggattacagctgtgagccaccgtgcccggcctgtccccagcttttaataacagtttattaaaacccagggtgtgagagccacagttgatatagatacagtcccagagtcatttactctttgtggtgtttttcttctcaagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctggtacgagggctgggacctggtagggcagggaggggggatgtgataaggcttagccaagtaggtaatagggctggaggtaataatgcaggacttttaactgtgttgacaatggcatggttagggctgagatgagggtaaatccataacccctgtctgggtgctgtaccatgtgtagttggcttcaggatctgggatgtccccctcagcactctcatcccacctggcagcagttcctccactgtgaggtgagtggcccgagcttcttaccagtgccatttgcttacatcctagtcaggactgatctctttgtgcacctctggtttttacccttgaatactaaagaaatgatgaaggttcgagtagaaaaatgtattgctgcctaaagagaaactgtttggacttagaggagtaaactgagtattttgtatgtgaacaacctagaaagaacgtctttaatctagctggctcatgttcttgcttatcgttatatatcaagaaaagtaaactggattatagtttcttaggtcatggtctaccttttgctgttgccttattgagtagtctgaaggttcctgaaaacagcgccttgcgtggggatggggtagaacaaaggcaggttcggtaagagctgcagcggttgcagcagtgtgtgggtcatggtcccaggttgaccagacatctcagcaagcatctgccttgctcagaagatcatgttcaggtgtagtccaaagtcagggagatggctccaggcagcaggtgtggtgcttgtctgggcaatgtggtggagttactcctttcccgtggttggttcctatttcagatggagcacctgaaagcctgtgcagagattgccgcccagcgaaccatcaactggcagaaattctgcatcaaagatgactgtaagcaatgctgctccttttgattgctgttattcattcattcaggaactgttaaggcctactatatgccaagcactgaactggatgctggagatatagctgtgaacaagatagactagacagaactctgtctagcaaagaagacaagtaaaaatctaaaagagtggtgagggctggtcgtcaaagtttggggagctgtagaagcacaaagtaggagtctctgacctccaggtagtggcagtaaagtcaaagaggagtaggtggagtctagagaaccccttattcaaaggagcagggggctctggtcggtgtgtagttaaaatacttttcagagatttccacagaaagtataacttcttcacaatgtccagcagagagaacatggcaaagaaagctggtgagaacagggcagtctcagctgtagggagacgttgttttggttctcctgagtctggttgaggtcgtctcagaggtgagcctctgtctcctctgcttgcagccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtaagggtcaccctcttgtcattgtgactacaatgatgtatgtaaatctctcttggagcacatggtttgtcctgttgtaaaaggtcttttaatcctgatttagaggggacttaaagcccaaatgttctctagtgtctacttttggtctcattttcaattatactgaagtgacaccttaaacagcatgacttctcataccaagtgacagtaataagaaaagtcaaagtgcactgaacatttttagtagaccaaatttcttattctgtgaaataataacaccttctctatggagctcccatcagagttcagtgaaatgacactgagtacattggtaaatgctcagtaaatgttagctctcttagctgaccctcaccatcagctgcactgctttccatggtccttggagacctgagatcagtggtcagggttgagagccatggtggtggttcacattcccccagttaatgatcagacatctctgtgtaggcctattgcaagcccttgaaaggaagttcctcctcctccagtgtcactgtatttgttcagtgccagcttacatagcactttatcctgtggtttttagtgtcattattgtatgtcttgtctggaaggcagctgtgctcaccactgcatcaccaacgttacacatatgtctcatttggggctgacctatttgtcccccagtaaacaactaaaaattgttttgcagaatatcagcattcagtagaaacttttagaaatggacagaattccctccctcaccatttggtagcccaggccttaggaccctggaggacttcttcctactcttcagcccttagtcctgtcctaatcttgcaggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacat

SEQ ID NO: 15179 - DNA, 1656 bp, Homo sapiens
ctttgcgggccactcggccaactgacgtcggcctctcctgtctggatgtccagtttctgtggctcactcctcaagccagatcatctgggactgagggtggcctctgggctcctgtagacttccacagccaggatttcacatccctccccagagcctcggaccgaacagccacaagcagccatgagtgtcgtgcctggactaagctggagagacaaaggcgtttgtggcaagggcccagctggaagccctggcaggccagagcatgcatgtgctggcttgcacgagcatactttggtgtttgtgttggggacaccgggcttctgagggactggcgtggctccagggtggggagcagcctggttgaagcgcggccaggcactcactctgttgttcagatcccagctccactgcctgctgtgtccacagtctcctcacctgtcaaatgggaatatctatgtggcgggagggtgctgaggtttccacgagctaatctgcctgctgtgtagtaactagtagcttttcttactgttagtgaacttgttttagtctgaaggaaggcacccatgccccaggtgaagtccagctgagttcagtgaggacgatggagacccttggtcttggcacccttctgccttatactgggaatgcctcaggcttgctcctgctgtgtgtctgtggttgcccactttctgctggtctccgagagactgattcaggtgttcaggagtctgttcgctattacatcacctccttgtgagaaataaagtggagcagcctcatccagacagcaaagcaaggagggagcgtgaggagcagccaggtgagctggtggcatggggccgcctgtgcagaggccggcctcgctgcttcatgtggctcagggaggctcagcacgtccgtcatcacacctcagggcagcgagagtggacctggtgccttcagaagcccacccgaggcctgctgctctggcctgcaaaggtggagtcaccaaagctcattacaaagtgtttgcttatttttgtctgccctgcatttttttatttcttgcaaaggcctcagaggatgtgggccccagcccaaacacatcttgttttcactagtagagcttttcctagtgtctgcacaggggtgcttccagtggctctgccatagccccagacaagctgctgacacggcagccatgaggtctgggacaggttccagggggtgcttttggcctgctccagcaggagtggaggctggactggtctccagcaggagtggaggctggactggtctccagcaggagtggaggctggtctgggctccagcaggagtggaggctggtctgggctccaggagtggaggctggtctgggctccagcaggagtggaggctggtctggggagagagctacacctccccaggcccaggtctcacgaaaggagcatcgaagggcaccgaggaaaaagccacttagccctctcctgtcctgcaccattatctgggcccattggttcttgggtccctgtctttctcaacaggcagccccagttggggaattaagttgattctggactggctatgcctaatgatagctgcaatttgaaacccataaagttcgagttcagcaataaagttggggaggcagtgtcaacaccttccttgtagaacggc

SEQ ID NO: 15180 - DNA, 14328 bp, Homo sapiens
ttaggttattggagtgatgagtaaagaatacataccaaagggcacacgttttggacccctaataggtgaaatctacaccaatgacacagttcctaagaacgccaacaggaaatatttttggagggtaagtaagggaaatttcttcagacccattaaatgttaggaaaaaatggagctaaaagagctgggtggctcacctttctcatcctgtgctgagaaatgctggggctcacccataagtatccagcatccccatggacacagggaattctgaacaaatgtgatgaaaccgatgaaatgtctggcctgtaggtggttagtgatggagatacgggctatatgtgaatcttgatttttgcaattcattagagctttgtaatgaaaggaaacagtttgttgcttgctttaaggataggttcatttgcatttctccgcaaggaagtagtaatgagttaccaagccttagatttcacccctttttgatttcttgctgacttaactttaattgaatggaagagttatcacaaatgaattatctttttggtttttttttttttgagatggagtctcactctgtcaccaggctggagtgcaatggcatgatctcggctcactgcaacctccgcctcccaggttcaagcaattgtcctgcctcagcctcccgagtagctgggactaaggtgcgcgccaccatgcccagttaatttttgtatttttagtagagacggggttccactatgttggccatgatggtctcgatctctggacctcgtgatccgcccaccttggcctcccaaagtgctggaattacaggcaagagccaccgcgcccagccaggaatgacaaatgaattaccttataagtaaatgccattaaggaaggatagctggaagatgggttgaggggaatggaggaccacagaactagtcctatttaaatacatgtgcatggtaaaatgattccatttgacaataggttaattatctcatagcataaggaaaatgcttaacagtcatatgcaagatgataagctttcctatagcatccaaccaaaagatctagccagtacaatttcctttgctatattagggttagaaaggcccccagaggtgaaccaattagatggaatccttgaataaaacactggattagcagtgaacagaaaaaagtcagattgctttccttcttcccatagatgtctcagggatatttagtttcctcagaagataaagaatttagtaagcgtttttttgtgcatacttacatgaaatgtacattatttgaattctttaaaaagaaacagctgcatgataacaaaaattgtgttatgcttgctttagctggtatttttgcctagaacgattatatcgttcggacaagaagctattcctaagaaacaatatttttaatccaggaagtttttcatttttagaaatttatcttactatttcccaagcaaaagagggtagttacagattcactaagaatcatgtgctcacaatttttatttaataattattcctccttaaaatatattaatcacctgacttacaatggtggaaccatgagtgcatttttgcctttattgtcaataacgtcttctcagaagtgagccacaaaggtgcatagttcttggagttaaaggtctgaattaagacaatccagcataagtctcattaatgtgtgattattttgagaaaaggcaagaagtacctaagaatctccccctcactgtccagttccctgtttcatttaaagattcactgtaagtaactgaaaggctttccttgggaggatttatttgaatcagtctttcacatgcaaaggatattgtagaacatctcgtttttgctggcaggaatatgaacatctgttgtgaggaaagaaaaagtttcatgcaaattacactgccaaagaagggatgttcaagttgagaaaccagtgacatttcttgtaactgtactatgaatcagcgcattttaatcttctagataatatatggaagtgcaggaaggtggtaggaaacggtgttcattttacatatgcgttattttattctgtgtgagtgacttcatggcaccgacattgctgtttttaaatgaggatacagtaaattgcagtccgaggaaggctaactggaatcaacatacccgtagctttagaaagcagtttccgcaccagcgaagagtacaagagcgatggaaccccatgttcctggaagtttgcacatcagagtaaacaaacttgaaaacccctcttgatagcagaattcacccagccttgttccattttctcttaacaaaacacaccgcaaaagctctcacaagctgctttgatgaagccacatgtatttcccccttcacaatttacaggaagttactcttaaaagaaagtgattctggtgtttaccgcctgtgttaaagggacagagttcctttttatttctgataacgtttgagcgaaatacagaaactatctgtagactagcatagtcggtacgtgagtaaggaaaagcaataacctgctgtccggtgagcacaaaattcctgctacgaacagtgccttactgctgcttggagactgcaagtcgcagatcacactaggtattgactgattgtataaggaaatttcttaaagtctaaagtaaaggtggtacctcctaaaaagaggggaagagagaaaactttgtgtggaaggataaggagtgtgtttatagtttcagtaagagtgtacgttttaatttttcttcttcctctgcctctttgccaagtagcctgagtgcatctgttatccagaagtagtattactctaggacaaacttcaaattcttcattctgcgttgcctttaaggaacaacatactttcttcctgttctttttccaaaaacacacgcctatggctctgtgtgtggtgttttagccagcctcctcccagataaggggttcccttccctcctttgcattgaaaggaaagtgcaagtctggacatgtttatcaagaggaaaagtgacttctcagtaatagactgtcaaattcgggctgctgcccgagtgttcgctttgttatggcaggtgaagttcacctttgccccacccagtgtttccacaaaaaggcaaggttccaagtattcatatgaacaagtgttactttaggacttggagggttgggggtggaggatgtttgcatagttgaagccttgggcgggggtgtaggaaacggcgagtacagaggccatagaaaaagctaagactcagtttgacgtcgtcagccggcttggtcttctacccagtgactcaaagcactaaaagtcagcataatcggaactgaagtcagtagcatcgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaaggtaactgacaaaagtgtgccttacctgtttccgccctgatttctgctgattcaagactattctggctaaactgattggattctttttctaactaggcagtaggggatcagaaatcacacacggtaccggctgtgtttattctgagaggtgctggggagctttgggtctgacttccttttacatgcctgtcttctcttttggacagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcagtaagtggattacagaacaaaaaaataaaaaatgccagtaatgtcggttctgcccctttgaactaataacatgttgtttaattatacggctttgtcatgtgttggatgaagtaggtggcttaagctagggactaggaagaggaaaaacattttttgagtccctattaactattaggaaacttgatcatttaaaagtatatatatatatgaggagctaccttgagttttgaattcaggatgttacaggaagaaatatatgtccaattctaatttatccaaaagcagttgggagaattacagggattggtccagacatgctgcgtatgcaaggtatagccctcatctgtggtactttggcagggcttagactgcatcaaaatatttatagatgtacatttgagtgtacagttaggatctgatgtggaacattgtaagatcattgctagaaaaactttgtcataatttttcaatattattctaagtgaataaccgtaaagattttacatcttagcttccttccttacagtaaaaaaactatctgatctcttgatcagtattatagtagccacctatcactttatcttaacaaattctcaattccttaggtttatgtgcttttacttcttttatttgattaaaattgctgtcatgacctctctctgcagagggctgcatcattttggtcattctcaagtgatctctttgagcaatttaagaattgccataagattctaacctctgctgtaactatggttgtgtgttcttggttagaccactaaatcttattagcagttttaaaaattattccttttggtttagaagttaagactaaatgctgaagtttttgtaacttttggttttgatatcatttcaaacttaagaaaacatttgaagaaaaggacaaagaatttccacttaccctttacccaggtttaccagttattgataagtatatccatttgctttaccagaaggctaacttgttttagttctcattttcacctttgagacatttggaataaatatcaatgttaacataaattggaattttgactttgattttaggaccaatgaacaagccaagtacttaccctagtcatatataatccaactgtatggttatttggtattcattccacacttcattttacttgatctcccttaagattgcaagattgtgtttgcagtttttctgaaaatctggggctataaaagcatcaggacctcccccgtaggggaggtcgtgtgtttggggtccttacacaacaggttacccttgagcttcaggaaaagaactggctctcagttccccagttccagcttaatgggtctaattaggtcctgaccaaaaaggtggcagttcttttccctcatgtctcttcagcgctccccgagactctggagactctgtcatatccctagggctgagcctcccaggaaccattcggctgttgtggcatctgtgtatgccatgcccagtgctgaggacctagtaacaaacgacaaatgcacaggcacagtggcatttttgtggaactcgtattccagctgtgcgtctcagaagaagcgcacagctccctcctggctttcttaacatagtgagccacttccacttaagggtctccttacattccttgagtttaatcattcatggattcagaggaaagtcttttgatttttgcttttctttaaacagttcatttgaggtgacctaccccagtgactttgcaccaaccaccaagaaacttttttgcatgcttcccgcaccctgtgccaatcaagggaagggtttaaaggcctggcgtttttattcctcaaagaaaggttttgcacagtattttaaggttcaagtgcttctactttgtgttcagaagcaactgtcatatatactgtgaaatgacaccttttatttatccctttttatttatgcagtatgtccccttttattttggcagaattttttctaaatggtggtttaacattttcaagcacatttcattgtccaatattcatagtaaagaatgagagttaacaataaccagtcacattaaaacaagattcctgctgccagttgtgaaaccggttgtcttaggcgtggcagctgatgattgagactgtgatcaggaaaatttccactatttcatcaggcctaataggtagattgtgtctccaaatgaactgtgttgggtttccatgcttaaagcacaatagaggtggtgcaagaatctccatgagggcttaaatggcagtgatggttcaggcggtagagtttggagaagaagggatttgaaacaaaccaaaggaaagaaaagtaagtagccagaaatcacaaaatggcatttttctaaaaacaaaggaaaaggaataaaagaactaataagtttgaaacccctacccctcccaaatttggcagggggggaggtattttttttctatctatctaactaacccatctagaaaacagttgaccaaattatagacttctaaatgttaatctgctttctcagtttcagttgaaaagagactttgttttgcctactgcagaacttctaggttctttcttatagtcttggggttcttattatagatcgaaaatgtgagtcggcataattaagccattcggagtcttcagaagcagttcactcttgaaatgactccgtccgcctacagccatttaagatttcagaacaaaaacagatcttgattttctttttcatgttaactcaagctgttgctgagtgggagagtcagaaatgacaccagctccactgattactcagctgctgaaggatgattttttaaaatgcacctttactgtatatggacttcctaatttccacctgtagagcatcttagggaggctaacatgtcactctggatgttcttttagaataagatgcaaatctatttttctgaaggcattagagatagcaaacatttattgtgagtttactatatactaggcactgtgctaagtgttttgcatagaaagtttaaaattctggcttttttgttggcccaatcataagtttcatatcagttcaacattcaaattatattaaggtacttaagaagaatccctggctaaatgtgaggggcagtgccacagatggactgaaactttatgcttattgcacatttatgctattattatttgttgaattatagaaccaagggagtgtggaagccactggaaaaaatatgagacttagatacataatttgagtaaaaatggctcaaagtcatgagggtaaagttttttgtatttccattttattcgagcggcatcgtttttaaaaatcattatgaatttgaccctatatagatgtttccaaataattctttttcaccttcataaaattccttcctgtggctgtgagatgccttgcctatcagttttcaagcttagttgtctttctcatcctttaccattttagctttaaaaaacaaaagtgacaattagaacttcctgcctgctgggcctcactgaaagaccgatattggcctgataaggagatatttattttgttttagtggcttcagaaatccctctccctcagcaagctttccatcacggcccccccgtcagcatcttccctgatagcgttcttctctgtgtttattctggggcttcaggctcgcccaggaggaactgataaccgctggcaggagataacattctctaaggggctctcaaattggaatcgaatccctcaagccagtcagcctagagaatacatttaaagggttcagttctggagtttcacagagttcatttctagacctatcagatagcaagtgtggagttctttctcaactaaattcaagcagagacattttttagacgatgaaggatatttgcacaaaggcttcagcatgatcccccaaacctgctgcctctgaaggcatctccacacattgacagccaatgccttcagtgcgttcctagggcaggtgtcctggcttgagtgactgtcctccaataatcagagctcaaactaaacatcgtatgttttacttttggtttccaggcaaggctgagcagggaattttcagttttccctgcccagatgggtgttttttcctgaaggcatcatttattgtgtagcgaggagacagggctggctgtggcagggatagtctagaactgtcctcattgctgctgttcctaaatagtatctttaccaagtaataacgtgccgtctttgggaataagtgctttcctcttagcctgttctgttttcttgggtgcgctaagtaattgaactggctcaggaagtacctattgtggtttggcagaggtgactgtcacgccttgtgactccaggggccagcactgctgggatcctggctagaccagacagagccttggtgaagtgcttaggctgtctgcacatcgcgaggaaggtggtattcacttcgctaagctccttggcataggcagtttgaacagggctttatcaaattcgtattcaacaagagtagaagcgaaaattgatgactgtgtattacttgaaatgagtcttaatctttcacatttagttctcagggtatgctgatttcctttaggtaaaccatgaacatcagaaagacttttattaacctatgacagggtccccaccccagtatttttccactccattaaaatggaagttttttttttttttttcttttttgagacagagttttgctcttgttgcccagtctggagtgcaatggcacaatctcggctcaccacaacctccacctcccagattcaagcgattcttctgcctcagcctcccaagtagctgggattacaggtgtgcgccaccacgcccagctaattttgtatttttagtagagatggggtttctccatgttggtcaggctggtctcgaacttccgacctcaggtgatccgcccacctcggcctcccaaagtgctgggattacaggcaagagccactgcatccagcttaggctatcttactccagcctaaacagcaattttctatcataaggtctgtactaatgaaaacagaatcacccaaggctgctgtttgttctgtctgtgctgccattgtccgcattttgctgaggaggaaacggaactgcacttttgagtgagtggcccagagccttctagaatgagagtgcgttggaagccagatatgtggcgattgtgtcgccagctgttactcaggttttctcaagaaggaggagcaactttggcagttttgcttcagttctctctagccctctgtgtaatcgcccctttttctttatttcagcacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtaggccttgagagagagcagtccaaggggctgtgagtgcatgcttgtgtttgtatttagcttgctttccatggggtatcgattgcatttgcagtagtatgagcccccggttggggatagtgggtatggattccgcctggcttttgccacttctagctctttgactttggacaagtgacttcccttctcctgattttcttctgaataataaaaaaattaggggtttggactagaagattaggtgaaactccctgctagcctgtgatttttgtgcttttaagaaaaacaccattctgaaaacatgaagatttcttctttttaagactgtcttgatgcttttcttaagatatttgcatcaacacttgagtcttggagcagaaatgttaggtctcagagccagcttgagagcagagctaacacatgtggcttcttcccaggtccacctgagagtgcacagtggagaacggcctttcaaatgtcagacttgcaacaagggctttactcagctcgcccacctgcagaaacactacctggtacacacgggagaaaagccacatgaatgccaggtgcgcagtattttctgggtagaccttctgacctttgtagaaaatgtctgtgagtcaccctcccatgtcctatatagcccgtagttaaagccaacaccagattctgcgttgtcccatcctggactgatggcactatggtccttcccagtactttgtatctgctgatgacttgagatggcacagccagcttccagtgggtgggaaaatggtaggggaaataaacagcccctcgtgtgctgtgtgcccacatccccccgtttgcttaataccacactggaggtgccacaaggaggcttctcacctcctaggttgctgggcgttggccggtaagcctgcccctcccgttggcaactcttaatcttctggccttcctgtctcccttccctgctgtctctctcccctacactgtaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaa

SEQ ID NO: 15181 - DNA, 14328 bp, Homo sapiens
ttaggttattggagtgatgagtaaagaatacataccaaagggcacacgttttggacccctaataggtgaaatctacaccaatgacacagttcctaagaacgccaacaggaaatatttttggagggtaagtaagggaaatttcttcagacccattaaatgttaggaaaaaatggagctaaaagagctgggtggctcacctttctcatcctgtgctgagaaatgctggggctcacccataagtatccagcatccccatggacacagggaattctgaacaaatgtgatgaaaccgatgaaatgtctggcctgtaggtggttagtgatggagatacgggctatatgtgaatcttgatttttgcaattcattagagctttgtaatgaaaggaaacagtttgttgcttgctttaaggataggttcatttgcatttctccgcaaggaagtagtaatgagttaccaagccttagatttcacccctttttgatttcttgctgacttaactttaattgaatggaagagttatcacaaatgaattatctttttggtttttttttttttgagatggagtctcactctgtcaccaggctggagtgcaatggcatgatctcggctcactgcaacctccgcctcccaggttcaagcaattgtcctgcctcagcctcccgagtagctgggactaaggtgcgcgccaccatgcccagttaatttttgtatttttagtagagacggggttccactatgttggccatgatggtctcgatctctggacctcgtgatccgcccaccttggcctcccaaagtgctggaattacaggcaagagccaccgcgcccagccaggaatgacaaatgaattaccttataagtaaatgccattaaggaaggatagctggaagatgggttgaggggaatggaggaccacagaactagtcctatttaaatacatgtgcatggtaaaatgattccatttgacaataggttaattatctcatagcataaggaaaatgcttaacagtcatatgcaagatgataagctttcctatagcatccaaccaaaagatctagccagtacaatttcctttgctatattagggttagaaaggcccccagaggtgaaccaattagatggaatccttgaataaaacactggattagcagtgaacagaaaaaagtcagattgctttccttcttcccatagatgtctcagggatatttagtttcctcagaagataaagaatttagtaagcgtttttttgtgcatacttacatgaaatgtacattatttgaattctttaaaaagaaacagctgcatgataacaaaaattgtgttatgcttgctttagctggtatttttgcctagaacgattatatcgttcggacaagaagctattcctaagaaacaatatttttaatccaggaagtttttcatttttagaaatttatcttactatttcccaagcaaaagagggtagttacagattcactaagaatcatgtgctcacaatttttatttaataattattcctccttaaaatatattaatcacctgacttacaatggtggaaccatgagtgcatttttgcctttattgtcaataacgtcttctcagaagtgagccacaaaggtgcatagttcttggagttaaaggtctgaattaagacaatccagcataagtctcattaatgtgtgattattttgagaaaaggcaagaagtacctaagaatctccccctcactgtccagttccctgtttcatttaaagattcactgtaagtaactgaaaggctttccttgggaggatttatttgaatcagtctttcacatgcaaaggatattgtagaacatctcgtttttgctggcaggaatatgaacatctgttgtgaggaaagaaaaagtttcatgcaaattacactgccaaagaagggatgttcaagttgagaaaccagtgacatttcttgtaactgtactatgaatcagcgcattttaatcttctagataatatatggaagtgcaggaaggtggtaggaaacggtgttcattttacatatgcgttattttattctgtgtgagtgacttcatggcaccgacattgctgtttttaaatgaggatacagtaaattgcagtccgaggaaggctaactggaatcaacatacccgtagctttagaaagcagtttccgcaccagcgaagagtacaagagcgatggaaccccatgttcctggaagtttgcacatcagagtaaacaaacttgaaaacccctcttgatagcagaattcacccagccttgttccattttctcttaacaaaacacaccgcaaaagctctcacaagctgctttgatgaagccacatgtatttcccccttcacaatttacaggaagttactcttaaaagaaagtgattctggtgtttaccgcctgtgttaaagggacagagttcctttttatttctgataacgtttgagcgaaatacagaaactatctgtagactagcatagtcggtacgtgagtaaggaaaagcaataacctgctgtccggtgagcacaaaattcctgctacgaacagtgccttactgctgcttggagactgcaagtcgcagatcacactaggtattgactgattgtataaggaaatttcttaaagtctaaagtaaaggtggtacctcctaaaaagaggggaagagagaaaactttgtgtggaaggataaggagtgtgtttatagtttcagtaagagtgtacgttttaatttttcttcttcctctgcctctttgccaagtagcctgagtgcatctgttatccagaagtagtattactctaggacaaacttcaaattcttcattctgcgttgcctttaaggaacaacatactttcttcctgttctttttccaaaaacacacgcctatggctctgtgtgtggtgttttagccagcctcctcccagataaggggttcccttccctcctttgcattgaaaggaaagtgcaagtctggacatgtttatcaagaggaaaagtgacttctcagtaatagactgtcaaattcgggctgctgcccgagtgttcgctttgttatggcaggtgaagttcacctttgccccacccagtgtttccacaaaaaggcaaggttccaagtattcatatgaacaagtgttactttaggacttggagggttgggggtggaggatgtttgcatagttgaagccttgggcgggggtgtaggaaacggcgagtacagaggccatagaaaaagctaagactcagtttgacgtcgtcagccggcttggtcttctacccagtgactcaaagcactaaaagtcagcataatcggaactgaagtcagtagcatcgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaaggtaactgacaaaagtgtgccttacctgtttccgccctgatttctgctgattcaagactattctggctaaactgattggattctttttctaactaggcagtaggggatcagaaatcacacacggtaccggctgtgtttattctgagaggtgctggggagctttgggtctgacttccttttacatgcctgtcttctcttttggacagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggagtttgcagaaaggcttcactacccttatcccggagagctgacaatgatgaatctcagtaagtggattacagaacaaaaaaataaaaaatgccagtaatgtcggttctgcccctttgaactaataacatgttgtttaattatacggctttgtcatgtgttggatgaagtaggtggcttaagctagggactaggaagaggaaaaacattttttgagtccctattaactattaggaaacttgatcatttaaaagtatatatatatatgaggagctaccttgagttttgaattcaggatgttacaggaagaaatatatgtccaattctaatttatccaaaagcagttgggagaattacagggattggtccagacatgctgcgtatgcaaggtatagccctcatctgtggtactttggcagggcttagactgcatcaaaatatttatagatgtacatttgagtgtacagttaggatctgatgtggaacattgtaagatcattgctagaaaaactttgtcataatttttcaatattattctaagtgaataaccgtaaagattttacatcttagcttccttccttacagtaaaaaaactatctgatctcttgatcagtattatagtagccacctatcactttatcttaacaaattctcaattccttaggtttatgtgcttttacttcttttatttgattaaaattgctgtcatgacctctctctgcagagggctgcatcattttggtcattctcaagtgatctctttgagcaatttaagaattgccataagattctaacctctgctgtaactatggttgtgtgttcttggttagaccactaaatcttattagcagttttaaaaattattccttttggtttagaagttaagactaaatgctgaagtttttgtaacttttggttttgatatcatttcaaacttaagaaaacatttgaagaaaaggacaaagaatttccacttaccctttacccaggtttaccagttattgataagtatatccatttgctttaccagaaggctaacttgttttagttctcattttcacctttgagacatttggaataaatatcaatgttaacataaattggaattttgactttgattttaggaccaatgaacaagccaagtacttaccctagtcatatataatccaactgtatggttatttggtattcattccacacttcattttacttgatctcccttaagattgcaagattgtgtttgcagtttttctgaaaatctggggctataaaagcatcaggacctcccccgtaggggaggtcgtgtgtttggggtccttacacaacaggttacccttgagcttcaggaaaagaactggctctcagttccccagttccagcttaatgggtctaattaggtcctgaccaaaaaggtggcagttcttttccctcatgtctcttcagcgctccccgagactctggagactctgtcatatccctagggctgagcctcccaggaaccattcggctgttgtggcatctgtgtatgccatgcccagtgctgaggacctagtaacaaacgacaaatgcacaggcacagtggcatttttgtggaactcgtattccagctgtgcgtctcagaagaagcgcacagctccctcctggctttcttaacatagtgagccacttccacttaagggtctccttacattccttgagtttaatcattcatggattcagaggaaagtcttttgatttttgcttttctttaaacagttcatttgaggtgacctaccccagtgactttgcaccaaccaccaagaaacttttttgcatgcttcccgcaccctgtgccaatcaagggaagggtttaaaggcctggcgtttttattcctcaaagaaaggttttgcacagtattttaaggttcaagtgcttctactttgtgttcagaagcaactgtcatatatactgtgaaatgacaccttttatttatccctttttatttatgcagtatgtccccttttattttggcagaattttttctaaatggtggtttaacattttcaagcacatttcattgtccaatattcatagtaaagaatgagagttaacaataaccagtcacattaaaacaagattcctgctgccagttgtgaaaccggttgtcttaggcgtggcagctgatgattgagactgtgatcaggaaaatttccactatttcatcaggcctaataggtagattgtgtctccaaatgaactgtgttgggtttccatgcttaaagcacaatagaggtggtgcaagaatctccatgagggcttaaatggcagtgatggttcaggcggtagagtttggagaagaagggatttgaaacaaaccaaaggaaagaaaagtaagtagccagaaatcacaaaatggcatttttctaaaaacaaaggaaaaggaataaaagaactaataagtttgaaacccctacccctcccaaatttggcagggggggaggtattttttttctatctatctaactaacccatctagaaaacagttgaccaaattatagacttctaaatgttaatctgctttctcagtttcagttgaaaagagactttgttttgcctactgcagaacttctaggttctttcttatagtcttggggttcttattatagatcgaaaatgtgagtcggcataattaagccattcggagtcttcagaagcagttcactcttgaaatgactccgtccgcctacagccatttaagatttcagaacaaaaacagatcttgattttctttttcatgttaactcaagctgttgctgagtgggagagtcagaaatgacaccagctccactgattactcagctgctgaaggatgattttttaaaatgcacctttactgtatatggacttcctaatttccacctgtagagcatcttagggaggctaacatgtcactctggatgttcttttagaataagatgcaaatctatttttctgaaggcattagagatagcaaacatttattgtgagtttactatatactaggcactgtgctaagtgttttgcatagaaagtttaaaattctggcttttttgttggcccaatcataagtttcatatcagttcaacattcaaattatattaaggtacttaagaagaatccctggctaaatgtgaggggcagtgccacagatggactgaaactttatgcttattgcacatttatgctattattatttgttgaattatagaaccaagggagtgtggaagccactggaaaaaatatgagacttagatacataatttgagtaaaaatggctcaaagtcatgagggtaaagttttttgtatttccattttattcgagcggcatcgtttttaaaaatcattatgaatttgaccctatatagatgtttccaaataattctttttcaccttcataaaattccttcctgtggctgtgagatgccttgcctatcagttttcaagcttagttgtctttctcatcctttaccattttagctttaaaaaacaaaagtgacaattagaacttcctgcctgctgggcctcactgaaagaccgatattggcctgataaggagatatttattttgttttagtggcttcagaaatccctctccctcagcaagctttccatcacggcccccccgtcagcatcttccctgatagcgttcttctctgtgtttattctggggcttcaggctcgcccaggaggaactgataaccgctggcaggagataacattctctaaggggctctcaaattggaatcgaatccctcaagccagtcagcctagagaatacatttaaagggttcagttctggagtttcacagagttcatttctagacctatcagatagcaagtgtggagttctttctcaactaaattcaagcagagacattttttagacgatgaaggatatttgcacaaaggcttcagcatgatcccccaaacctgctgcctctgaaggcatctccacacattgacagccaatgccttcagtgcgttcctagggcaggtgtcctggcttgagtgactgtcctccaataatcagagctcaaactaaacatcgtatgttttacttttggtttccaggcaaggctgagcagggaattttcagttttccctgcccagatgggtgttttttcctgaaggcatcatttattgtgtagcgaggagacagggctggctgtggcagggatagtctagaactgtcctcattgctgctgttcctaaatagtatctttaccaagtaataacgtgccgtctttgggaataagtgctttcctcttagcctgttctgttttcttgggtgcgctaagtaattgaactggctcaggaagtacctattgtggtttggcagaggtgactgtcacgccttgtgactccaggggccagcactgctgggatcctggctagaccagacagagccttggtgaagtgcttaggctgtctgcacatcgcgaggaaggtggtattcacttcgctaagctccttggcataggcagtttgaacagggctttatcaaattcgtattcaacaagagtagaagcgaaaattgatgactgtgtattacttgaaatgagtcttaatctttcacatttagttctcagggtatgctgatttcctttaggtaaaccatgaacatcagaaagacttttattaacctatgacagggtccccaccccagtatttttccactccattaaaatggaagttttttttttttttttcttttttgagacagagttttgctcttgttgcccagtctggagtgcaatggcacaatctcggctcaccacaacctccacctcccagattcaagcgattcttctgcctcagcctcccaagtagctgggattacaggtgtgcgccaccacgcccagctaattttgtatttttagtagagatggggtttctccatgttggtcaggctggtctcgaacttccgacctcaggtgatccgcccacctcggcctcccaaagtgctgggattacaggcaagagccactgcatccagcttaggctatcttactccagcctaaacagcaattttctatcataaggtctgtactaatgaaaacagaatcacccaaggctgctgtttgttctgtctgtgctgccattgtccgcattttgctgaggaggaaacggaactgcacttttgagtgagtggcccagagccttctagaatgagagtgcgttggaagccagatatgtggcgattgtgtcgccagctgttactcaggttttctcaagaaggaggagcaactttggcagttttgcttcagttctctctagccctctgtgtaatcgcccctttttctttatttcagcacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtaggccttgagagagagcagtccaaggggctgtgagtgcatgcttgtgtttgtatttagcttgctttccatggggtatcgattgcatttgcagtagtatgagcccccggttggggatagtgggtatggattccgcctggcttttgccacttctagctctttgactttggacaagtgacttcccttctcctgattttcttctgaataataaaaaaattaggggtttggactagaagattaggtgaaactccctgctagcctgtgatttttgtgcttttaagaaaaacaccattctgaaaacatgaagatttcttctttttaagactgtcttgatgcttttcttaagatatttgcatcaacacttgagtcttggagcagaaatgttaggtctcagagccagcttgagagcagagctaacacatgtggcttcttcccaggtccacctgagagtgcacagtggagaacggcctttcaaatgtcagacttgcaacaagggctttactcagctcgcccacctgcagaaacactacctggtacacacgggagaaaagccacatgaatgccaggtgcgcagtattttctgggtagaccttctgacctttgtagaaaatgtctgtgagtcaccctcccatgtcctatatagcccgtagttaaagccaacaccagattctgcgttgtcccatcctggactgatggcactatggtccttcccagtactttgtatctgctgatgacttgagatggcacagccagcttccagtgggtgggaaaatggtaggggaaataaacagcccctcgtgtgctgtgtgcccacatccccccgtttgcttaataccacactggaggtgccacaaggaggcttctcacctcctaggttgctgggcgttggccggtaagcctgcccctcccgttggcaactcttaatcttctggccttcctgtctcccttccctgctgtctctctcccctacactgtaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcgagatcggcttccccttgtgcaggaaagatttcttatctaatgatttgcttctatagaggagaaaccgagtaaatgtgctccagcaagatagactttgtgttattttatcttttattctgctaagcccaaagattacatgttggtgttcaaagtgtagccgaaaatgatgtatatttataaatctatttataccactatatcatatgtatatatatttataaccacttaaattgtgagccaagccatgtaaaagatctactttttctaagggcaaaaaaaaaaaaaaaaaaaaaaagaacacttcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgggctttcccatagtgagaatttttataaagactttttgcttctctcaccatccatcctttttttttctgcctcttacatgtgaaaggtgagcccacaatcaacagtggttttattttttcctctactcaaagttaaaactgaccaaagtactggctttttactttgctagaacaacaaactatcttatgtttacatactggtttacaatgttatttatgtgcaaattgtcaaaatgtaaattaaatataaatgttcatgctttaccaaaa

SEQ ID NO: 15182 - DNA, 1374 bp, Homo sapiens
tttaaatatatatatttatatctcaagactgctctgagatactcttgtccccagtagttttactgccaacaaataccaataatgacaaacggtgattaaaagggcagatagatgtaaatgaaggcagaggaggaggatgaaatgaacatctgcttttttcagctctctgacagaaattcttaaaggaccaaaaataacactcttgtttcaacttatgttaggtgtaggaaaattttctttttttctctttccagtctgagtatgcttcattgatttgtatattgaatactaaattgttttagaaaaaaaaatcattggctgataagacacttaaatgagaaaagctagtctgtcacaggcatgtaggtgtgccatatctatttaaatagaggtttaaattattgatgagacttaatgaggaactggtgtatattgtaaccaaaattgtagattccactgtgaacaatctgtgcatggatcgattcacatatttgagtctaccatttcaggtacatgaatgtacaggagctactgggaatataaaaactggaaaataaacattatcatctattaccactccctcctccttggtccattttagtaaagaattcagtaaagtgataggtaggctatcttgaatgagaagaaaataaaactaggaaagtgagagaataaaaaccaaaacaaaactgtaactgcaaactgttgtaaaggactactcacagaggagttctattgaatagtgacgaattgcttcctgattcacggttggtgatttttttaccccttcaaagagaaatttattattaaggaggaactggtatagttaacatgtttctttagcaaggccccacaaagttaaaatgtgtgatgcatccagtctgaggtcatttcctcagatcttagaacctacagctttcctccgtataaacttaatttcaaaggagggcttttggccaggcatggtggctcagcctgtaatctcagcactttgggaggccgaggtgggaggatcgcttgagtccaggagtttgagacaaggctgggcaacatggtgagaccccttctcaacaataacaacaaaaattagctgggcgtgatggtgcatgcctgtagtcccagctactcaggaggctgaggtgggaggatctcttgatcccaggaggtcaaggctgcaatgagctaagatcaagccactgcattccagcctgagtgatagtgggagaccttgtctttaaaacacaaacacacacacacacacacgagggcctttgaccactcttgagtagaagactcgagaagaacaaagtagaaggccagagaagaacaaagttacttgaaagatctcttattaaagagaatgtacaagctatg

SEQ ID NO: 15183 - DNA, 3331 bp, Homo sapiens
tctagagcttttgctccattcatttacatatcattttattaaaaacttactaagttcaaaacaatgttaaaataagttgtccctgcccttggggagctcagctaagtaggttttgtttttcatatttctgctgcaagtgcctccgatgcctgtctgttgctccttaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggatttttttttttttttttggcttttgtttttgtttgtttttttgtttcgtttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaatctcttgtaccttgcttggatttttaatgggttgatgtgtcctgccattaggtcccgtgttacactaggtcctgtgtgagaaagactgcactgcactgtgtgagagagtggcctctgggatcaggggctcatcctccccactgccatagcccaggtgcccagaagaggtggtgcctgacaccggctctcagtcttgggacggctccaagggttcctctggacctccagcttgttacttttatgtgcagcgtgtcccacctatgttgtttggctcccagcccaacaagtcacagttaggtgctccataatgattcttaagatgtgatgcttatgtagctccttattttgcattttcccttcacctgtttgcttaaaaacatgttctctagtcattacctcctagcaggtcctctgcacagccttttgctttctgggcacgcatgcatccctccgtgcctgggcccacaggcatctcacacagcactgagtacacacctctgcatgctgggcccgcaggcagctcactctgagctgtctgggtacccacctctacatgcgagtccataggcatctcactggcaatcgtgtaaccagggcacaagctctccagccgggtggctcatcacagcccaactcagccactcatgatggtgtgaccttaggcaggtcttggtgtcagctttttctgttgggtggggaaacaatgggaacaagttcaaagacttgaatagctttttacttacggtaaatgtttaacaaacattagctaacttttactcacttaaccccataatgtcacctgctagcctttctaaatttccacttcaatcccacctattatttaaaacctttaccttcagaaaagttgagcatcttaatcagatgggtttcactgc

SEQ ID NO: 15184 - DNA, 11585 bp, Homo sapiens
ttgtgcactcattcatttaacagacatttattaagcgtctacaatgtgccaggccctggggacacagagctggagaatgtacagtccctgccctcaaggagctcacagtctggggggacagacatgtaaacacatgagttacaacgcgctgcgtgaagtgtgtggcagaggtataacaaagtgctgtggggcacaacagagcgaccagtgaactcttcctgggcaggggtcagggaagccttcacagatcagtcaataaatacggtgccatgggagtgccttgcacaccacgggcactcacatcttgaatgctggtccactggaggcccttgggttgggcgggagcaaggcctacttctgcttcctcaggacaacttccccacctctgtcctgggaccacctgcccgcctgggcctgcagtgactaaggacgctgctcccactccaggggccagtgacagagagcagctatacagagggcccaccccgcaggatccttgacaggagctgagacagaacaaactgctgcttgtctccctaccctgggggctgtgatattcttggtaacatctctgagctggtctgtgaggtcacttcctcttttaacactgttgaggagactccaaaccctgtcttttcctcgtcttctcatgtcgattgggcaccagccattctcaggcaccagagcacagccccacacgggtgccccatcagacagggctgcccacagcagcctcctacacctgaactgggtttctctgcacactcacagccgtctcaccagctcaatgagctgctggatgtttttgttttggttcgacaagccgttcctgatgttttcgagtaggcatctcttcaattcaaatatggcttcactgtaggccaagctcactgcggccatgggaggtgctccgtgccacaggcctgggatgtgccagatgtgctgcttctcagggtcgcagaaggccaggcctgccagtgcccggaagccgtcgccctgtttctccatctgggctgcagccctgctcaggtcaccaggtggatccaggagctgtctcttgtctctgggcctagggccgggaacagatacatcatgaaggttctggtatacaaactggtagttgggcatgtgccccgttttttctaacctcagaaatgcatgcagaatagctgctggaatgtccttggtttcagctagactgatcacggtgacattgctcagtcccatgagcagagtggccaaggaagcctccagctcaaatctgtccccagctgacgtcaaggccccacctatcaagcccccggagtctatcaccaggatgtggtcacagcccaggtcctggctgaagccctcagccactgtgatgagctgcatgaaggcccctcgaggaccgcagctcttccctgtggcaaaccgcagcccaaacatggtgttgaggagtgtggacttgcccgtgcctggcaccccgacggttgacagaaccaccagccttgaccgtctctccagtcggacgtgcagctccttcaggagccctgtgacccagcggacgggcatgctcagcgtgctcccatcgattagctccagaggcagccctgtcagcagcagctccgaggccaagcctgggaagtgggcaaaacgcctctggcctgccggcagcctccctgcctccacaagacagctctcagcctcataaaactgtcccatctcccgcaagaagtgttccacccctaggggctcaggccagagcggctcccccacgtctgtggtgcccccatgctttggtctcagggtgagaagcgtctccggaggctgtctcagtcgcggctgggccacccgtgccaggccccactccatccacctcaggaagtactgcttctcactcaaggaggggctgctgatccccgagatgaactcctgcacccccgaggagggatcatggccgttctgctgcattcgaagttctagcagccgccgcctcagctcagccctgtgcttctcaggggggtccacggcccactggagctggcagaactccttctccacttgggctgcctttctccaggggtccccctgcagcctcagctcgtcccttctgtaggcatccgagtctttgattttcctggtaatcctctccatccggtctttcgctttctgacactcctcacagtcctcgtcgacctttaggcccagtttgcgggctgcgtgcgccatgtcctccacagatacccgcctgcagggtgcccgcagcacattcccaacgatggcccggatcctcttcacgaagctgtcgctgtcagtgctgctgacctttaccaggacatgtgagtggtctattttcagcacaggaattaacttattcagaaatctcaggtttgtgttgcgcttcccacggtagggactcaggatgaagtagtattttgtggttgactccttcatggagtacagcaatttgtattccttcttactgatattgtcagtcaatataaacacagcggaggagatttctgtcaagagcttaaactgcagccagtgagacccgatgtcacctctcaggttcagaaaggccacaggttctgggaaaatgtccaagtcctcccttccgctgggaaaaaaccaggaaatttctaccaacccatccgaaatctcccgggcattggtgcccaagttgaggtcccgatgccagaagcagtcccactgcctgtggcccgggctgaggacggcgttgagaagctgggacttggagttgctactgacgtccatgcgcacgaaggcgaaggcgggcgccctggacaagaccacgctgtcttcccggaagctccccatgccccttgggggctgggaccaccatgtcctcacaatgccccgcatggcccacagcagaaatgtatggtagtggttctccgagtcaggcaacacgagtgggagtgcaaactggcagagggccattttcaacgctatttcttgttgcaggaaactgtctgaggagagcagcagggcacagagaaggtctaaggggttcactggcgtatcaggggtgggcagctcagaaaaggaataaatgtcggcagcaaggtcatcagctgggtcccagtagatgatctcctcttccatctggctctccttctccacaggcctggcgtctgggagcacgtccagcaccatagtggtattcctggcatcagcattgagggcctgcaacttcctgaggaaattccagggcaagtctttgggaacctgaggggcccagttcttcatactgtcaaaactgatctgcagagagtcctggaggctgagtttctggacctggtacgtctctaggcccaaaagtgacagcatttcttgaagcctgcttctctccactgtggaaagaaatgaagacataagtgctcaccctgtgtttctgagctaggggccagggaagagctggtgaaggagagcccagcaggatggggagagtgacgacccccttcagagagcagagtgcaggcacaggaggctcagggtgtgctcaaggctgacctgagatcaaggcagggctggaacccggacatcaaggtacaataggtaccaacctaaccacagatatatgtgacattaaacaaaagaaagaacagaaataaataagctacatttaacaactggaagagttcttgcaaaagccatatttctggtctttctagaaacctgtaagatctaacactgagctcaaaattaattggctacagtgagcagcacatgactcctacaagctgaatgcaggcctcacctccccactgtgttgcttccgtgggctactcagagtcaccgggaagttcccacaggagtcataatcactgaatcactctctggctttctagttaatgtttttttgtgttttttttctctctagaaataagagaatattttaaaggaactagaaagaaatcactaagcataaagagtcagcaattatagctaaacaaccattttgcaaacctgaaatcaataatgcaggttttcttttttttctttcttttttcctctcccctttcttttttttttagacagggtcttactctgttacccaggctgtagtgcagtggcatgatttcagttcactgtagcctcaacctcctgggctcaagagatcctcccacctctgcctcccaagtagctggaactactggtgtgtgccaccacacccagctcatccttgtatttttttgtagagatgggtttttgccatgttgcccaggctggtctcgaacccagactcaagcaatccacctgtctagccctctcaaagtgctgggattacaggtgtgagccatggtgcctggctttaatgcagttttaaattttaaatgtattaaaatattcagtgcagactgttagtaagtgagcacttacttgcgcagatactcaaatatcaccctatacaatataagatcttataagctagatgcttgaaacagtattgctacctctgaagattccattcaccatccaggtcttggcccagcaccttactaatgttcatgctgcatattaattagttgtcttaaaatttgttgttgtttgaggcagtgtctcactctgtcacccaggctggaaggcagtggtgtgatcacagcttattgcagccttgatctcctaggctcaagagatccactcatctcagcttctgaggagctgggactacaggtgcacaagacacttggctagtttttgtatgttttgtagagacgggattttgccatattgctcaggctggtcttgaactctctggctcaaatgatctgcctgcctcagcctcccaaagtgctggatgtgaggcaccgtgctgagtcactttaaatgttaatgcatgaagtaaatacaaattccactgccctgcagccttttttccagttcctttctcgagagaggaagcaacgtgtatgatactgctttgatgcttagataaaccatgaaaggaaacactgggtgacccagccctctgcctgtttcccaagaaggtcaagtgatggattcaagaccactttccatacgaccagcaggactcacagtgctggacactctgctcagagagttccacaggcattgtggccacaggactgccccacagaacattaggggacctatgaacttgttacaaaaacaaaagtactatatgggaagagtcacattgtgccaaaacaggtgttactcaggtttcctagctttgcctgaatgaaactaggaacattgtttttcttgtccagacatggaataactttttattttttaagtagcatggtagtaaaaggcaatgggaaaaagacaaagaaaacacttctgcccagtgtgtggcccttggcaggttgtttggaagctctgggcccagtatcctgatctgcaaatgaaggcgttggaccagataaatcgtttccaaaccgggctgtacattagaatcaatcacttcaggaacttgttaaaaaatgaaacatctctgggtttcacctccaaacatgctaacttattaaaggcagtgagtatgttgggtggtggagggggggcctggttactctatgtggttagcaagcttcccagggtttttttttttttttttttttagcaatatggttaacaatgtataaagggttaatgaagtagggcatcctaaacctgagtgctctgcctccccaggtgatttgatacagtcaggtgtgggaactgctggcctagatgataaccccctttcatagaacagagagaaaaggcagagaaaatgcttacctgttggaaaatcattgtcctgagcctcatttgtaccatctatggaaaaagcaatggaaaatgaagtgtcaatcaaataatgcacccttggctgacacaaattaattgaagctaaacctagaacccttctttctcaccaagatggcaacttctcccaattgttctaaatataaaatcccggttatctgtcactttacccactccccctctccccagtccaatctgttgccaaatcctgtagtttctacctccataacggaactcgcaatcatctccttccatttctctccattccaaatctagaagaaaaaagaaaccaaatacatttagtttcatcagcaagttagaacctttctgtcaaaaatttcaagtgctcatgcctgtaaccccagcactttaggaggctgaacaagaggagtgcttgagtccaggagtttgagaccagcctgggcaacaaagcaagaccctgtgtctacaaagactttttttaaaaaattaggccaggcatggtggctcatgcctgtaatctcagcactttgggagcccaaggcaggaaaatcacttgaggtcaggaatttgagaccagccagcctggccaacatggcgaaaaaccatctctactaaaaatacaaaaattagctgggcgtggtggcgcatgcctgtaattccagcttggaattacttgggaggctgagacaaaataattgcttgaacccaggaggcgggggttgcagtgagctgagatcatgccactgcactccagcctgggcgacagagtgaggctatctcaaaaacaaacgaacaaacaaaaattagctgggcatgatgccacgagcctgtggtcccagctgaggcaggaggattacttgagcctgggaggtcaaggctgcagtgagctgtgattgcaccactgcattccagcgtgggcatcagagcaagaccctgtctcaaaaaaaaaaaacaccaaacaacaacaaaaaacgtcaagtgacaatatggtggctgatgttttagtgctattattggtttcagtttttcctatgtaaatgtaatgttttgccagcaaaaaatacatcacaaggtagtaatagctacacacaagacacagatttgctctaggatatatctttatagaattttctaaactttgggaaaataaaacatgaataaccataaaacttacatagattaacctttgattttagaaactatttaaaatgtaagttgacagaaattccttgactatttaaaaattcagcacctgtcaatgttatttttattccagcataaggaatttttgtaatcacttaaaattgaaatgtacatcagagcacaaatacacagaggtgaggtgcggggggagagacagtggggaagagttgtgacttacaagtgaactgttatttgtccaaagtctccaaacatcatgaaatgtccatcaacattaacatcttaattacaaaatgtgtttaatgtagtgctagtcagatatttatgtatgaacaaagacctaaaactctagatttgcttgcaagcacacaatataaaggagcgaacaggaggcttaggaaggagggagcaagacttctcagtgcatgttttgactattttgactttgatccaagaaaaagtaacacctaggttccaaaatttatatatataaatatatatatatatacatatatatatatatatatatatatattttttttttttttttgagatggagtcttgctgtgttgcccagactggagcgcagtggcgcgatctcagctcagtgcaagctctgcctcccggattcatgccattctcctgcctcagcctcctgagtaggtgggactacaggcgcccgccaccacacccagctaatttttttgtatttttagtagagacagggtttcaccgtgttagccaggatggtctcgatctcctgaccttgtgatccacctgccttggcctcacagagcgttgggattacaggcgtgagccaccttgcccggccccaaaatttatatttttaagagcttatgaatcaagattcggatattttcagatttatgttttctcatgatttccatgtaatcaggtagataaacctaacatttcaaaccgtcttctttgatgatatctctgggagatggacatgtgaaaagcaggaaagagaaaaagaaaatggggtccaggaagcatgagaagatcagagaaggcacaagatccacacacatcaaccacaatgccaagcagtccaaagattacattattcaagtgaggaaaagccatcagaacaaattttccaaggaacccaaaatgccctgtgaggagagaaaatggttagagaaaagaatgggaaagtctaaagatgccagagatagggttagggtggttctgagagtagttttaagctggagtcaggagtaacctccagacccagagaaaatagggccttgcttggttaggggtgggaaatagctctgatgtggatttaataggtggatgaggtcaaggatgcacaaagtagccaaagactgagggttaccaaactaaggaaaccactgactagggttcggagagagcctgatgttctgcagccatcagcagattgtggggcaggtggaagaggaagcagcagggctccaggcaaagacacaaaacagcaaacatggggggccactgagggctcagctccatgagccaacgtctccactatacttcacattgggcaggaagtgacctaaggatgagataagctctgactctgggagtactgggctcacacggaacacagggacagaggataggccaggccctaccaccatggtgagcccaggaataactgttatgagcccattgttggagaactccaagtaaggccattaaaaccattttcaagccaggtggggtggttcatatctgtaaccacagcaatttgggaggaaaacgcaggaggatcacttgagttcaggagttcaagaccagcctgggcacaatagcaagacccctgtctctacaaaaagttttttaaaaaattagtcgggtgcagtggctcacacctgtagtcctagctacttgggaggctgagacaggagaatcccttgaggccaggaggtcaaggctgcagtgagctatgatggccaccactgtactccggcttgagtgatggagtgagacaaaaatagaatgagctatgaagtagaatcttcagagttgagtaagataaataaattatatcgtgtgactacataaagtataaaccaggcaaagctaatctatccttttagaagtccagataatgacagatgagaggtgaagtaactggaagggacctttgggggcatgggttttcttcagcttctcgatctggtttctggcttacataggtaagttcatgtttgtgaatatttctcaagctattaattggagtacttttctgaatgtatagtataatttttttttttttttttaaagacagtcttgctctgtcgcccaggctggagtgcagtggtatgatcccggctcacagaaacctccacctcccaggttcgagcgattctcctgcctcaacctcccgagtagctaagactacaggcgcccaccatccctcccagctaatttttgtatttttagtagagacggggtttcatcacattggtcaggctagtctcaaactcctggcctcaagtgatctgcctatctcggcctcccaaagtgctgggataacaggcatgagccactgcacctggcctgtatagtatactttaatacaacttgtttttaatcctataggcttaaaaccttgctttaagtctttaaaatgaagcatatgctcaagaggaactcacataactcatgaagaacaactataaagaataaccactggaggtttattcagtagagagagacacagagatcaaagttcggggaagaaccagggtgtctctgtgccttggtttcctcaaatgaaacagggattgataagtatcttagaggtcatagttaaaagtaattaagacaacctagctcacaataagcatccaataaggccattccctctcctcgccccatccccatgctttctttctcatttgtctagaacaacactccccaagggaacctcccaagctgaagttctccatctgcaatgtccaagctgcagccactcaccatgcaggctgctgagcaaatacagctagagtatttaggaggtgaagttttaattctgtttaattttaaacaatgtgcctagtggctactgtgttgaatagcataattctagatgtggagaaactaaagggctttgggcaattactgcctgatcccaattctgctacaagccttgaccaactggccaataatccccatggtgcctaccttccagaatttaagttccatgaagggctttgagccttttcatttactattgtttacaatatcgcaatgcttacaacaatgttagtgcatggtaagtactcaaaaaatatttgtttgaatgaataaaatagtgattttttccatagagacggtgtctcactatgttgcgcaggttggtctcaaactcctgggttcaagcgaacctcttgccttggcctcccaaagtactgggattacaggtgtgagccactgtatccagcctaaaataaaactttattaaccaaaacttatttgcatatttttgtggatttttgtttttgcataactctattaatatccaatagaacacttttttttttggcagttaaaacatagtttatttttttagcacattcattttaagaagaacctaatttatgaaagatatatctaaaatgagttactggctgggcacggtggctcacgcctgtaatcccaacactttgggaggctgaggcgggtggatcacctgaggtcaggagttcgagaccagcctggccaacatggtgaaactcatctctactaaaaatacaaaaaattagccgtgcatggtggcgcatgcctgtaatctcagctacttgggaggctgaggcagcagaatcacttgaacccaggaggtggaagctgcagtgagctgagatcgcgccactgcattccagcctgggcaataaaggcgaaacttggtctcaaaaaataaaataaaatatcaaataaaataataaaagaaaagaaaatataaaacaaaatgagttagtaagagagctaaagatatctggagtgtggccaccataccttaaaggtgaatttacaaagggtggcgttacagccccacccccaaatcctcagagaaagaaaaaccagcctgtatggaccataaccaggaagactacaagccccagtgtgctctgggacaatcccaatttatacctgttttcccaacattacatccctttcactctcagaagtgcccactttagaagataaactatacagtcaccttaactatgacctacaatggcagttatgctaaaattggggtaatgtgtttctgttaaattgtgtcataatcacctgtttaactgaatcctgggaacacttactccattttctagaataaagtgttgcccataaaaaaaacaaacaaaaaacactattttgaatatatgaggaatgcttaaaagacccttagatggaatcttcttgtaaaaggaaaaataaaagccttaaacttatttatttttgagatgcacaatcccaagtccaggaggggctggaacccagaatcccaaggggacaggagaagtacttcagctccagagtgggcccacatccaattcatccaactttacctgcaatggccacagctgttcgtctctctgatgcttttatttctggggctacttctcccaaatctgaatgcc

SEQ ID NO: 15185 - DNA, 1115 bp, Homo sapiens
ttagtgactcagaaagaggattttcccttttactgggctaatacaccacacctgaggagttggggtagttaccagatcaggtttatattgtataaactgcagaccaccaccagttctgctaggtgctgtttcagtaaattaagatagtatcgatgagaagatgctgttttacataccattaagaaggaaaactggctgcaaattatcttaaggtaccattgattgattaaaagatgaatcctgatctgacatgttaaaatgtttgaggctgatgcagaaggcagtttcctctccacaaacctcatgggtgtgcagaatggtgtagacacagagatgggtgcctcacttacctcatgcacagactggcttttccaccacagggcaggcactgtataagcaccttccattcctacacaggcgctagtagggggaactaaggcttggagaagccaagtaactttgctaaagggtcatataattagtaggaagtaaggctgaggttcaaaaccaggccggacatccaatgtgctgaagcaagctacacctcatctcacaagagaggcgaagacacgcttgttccttgtcccaagcactcttcaggcccatttcctccaagatggtacttgcttggtttgacactttcatcaaacaggaccccttgtgagcacacggccatgctctggtgagcagcctgccgccctgtccacctttctgggtggctctctctctactaagcttggctccaaggacatgaccgtccagtagccccatggcaaattctggggcttctcagacctgaaggtgagcattttgagctccagatatgaaaggcaagtcctgggtgttgtgttcattggaatcctaagagcagcactgactggagggctaaaggcaaggcccatccacagttcacagacttgaaacatcaacccttcaaaaagggtgggaggaggctgggtacggtggctcactcctgtaatcccagcactttgggaggctgaggcaggtggatcacttgaggccagaagtgtgagaccagcctggccaacgtggtgaaaccctgtctgtactaaaaatacaaaaattatttgtatttttgtgatggtgggcgcctg

SEQ ID NO: 15186 - DNA, 65854 bp, Homo sapiens
ggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggtaacttactttccacatgatcaaaaatgtcaacaagtacgttttctgaaatggccgtatgttctttatgtaaacagttttattcagatataattcacgtgccaattcaaccatttaaaatgtaccattcagtggtttttgctgtactcacagatgtgtgcaaccatcatcacaatcaattttacaacattttcatcacctcaagtagtaactccctgtgacccgactacaccagctaaacacacacacacacacacacacacacacacacacacacacacacacacgaaaaagtaacacttcgccctttagctaccatccttattccccctcctcccctagccttaagcaactactaacctttctgcctctatagatttccctattctggactttcctatgaatagaatcatacgatatgtggtcttttgtgtccatgttctttcacgtagccttaatgttttgaagatctatgttatttttgtcggcccagattgagagtgtgccagaaattaaatgtttgaaggggttaccatgctggctgcttatgacgtttgtttttgtatctagtacttgaaaagttataacacactcaccatcatgctgtccataaagatgacacttttgtttctttttgagacagataatatctgtcacccaggctggagtgcaatggcatcatctctgctcactgcaacctccgcctcacaggtttaaacgattctcctgcctcagcctccccagtagctgggattacaagcgcctgccaccatgcccagctaattttttgcatttatagtatagatggggtttcaccatgtttgccaggctggtcttgagctcctgacctcacgtgagccaccatgcccagccaaagatggcacttttggtcacttacattcttctgtggttgggtaaacctgggctacaaaactggtttcccagagacattcataattctctccttaactttatccaagcttaatttttaatttttattttttgagacacagtttcattctgtcccctaggctggagtgcagtggtgtgatcttggctcactgcaacctccgcctcctgggttcaagtgattctcctgcctcagcctcccgagtagctgggattacaggcgtgcgccagcacgctgggctaatttgtttctgtatttttattttttttattattttttattttatttttattttttgagatggagtcttgctctgtcacccaggctggagtgcagtggcgcaacctaggcttactgcaacctctgtctcccaggttcaagtgattctcctgcctcagcttcctgagtactgggacaacaggcgcgtgccactgtgcctggcaaattttttaaaatattttttagtagagatggggtttcaccacattggctaggctggtctccaactcctgacctcgtgatccgcccgccttggcctcccaaagtgcggggattacaggcatcagccaccgcacctggcctttttttgtatttttagtagagatgcggtttcgccatgttggccaggctggtctcgaactcctgatctcaggtgattagcctgcttcggcctcccaaagtgctgggattgcaggcatgagacaccgtgcctgtcctatccaatctttatacctgtttctttttttttttttttttcctttttaaggaaatcttagtaagtagaagtttcccctaattataccctacagattcaatctctataatttggacctcattcttttttcctatatatgtattaacatgactgttattttttatgtttatttcatcatttacaaaaaaccagttgcctatcttgccattagctctttgctgtctcccacctttccccaacttcttatcgtctcagctcatgttacaggcactcttggcagagccttctttcctttctgaattggtgactgctgtcatcaaaagaaggtatcgggggcagggtatggtggctgaggcctgcaatcctagcactttgggaggccaaggcaggcagattgcttgaggtcaggagttcaacaccagcctggacaacatggcaaaaccccgatgctactgaaacaaacaaaaaaaattagccaaggatggtggcacacacttgtagtagtcccagctacaactacttgggaggctgaggtgggaggggtcgcctgagcccaggaggtcaaagctgcagtgagctgagatcgcgccactgccctccagcctgggagacagagtgaggaccctgtctcaattaaaaaaaaaaaggttttgggaacctgtctacttttgctatcagcttaaaatcactgtttaccaccttccacctgttagatttttctcttttgtcaggaaagaatcctgtcttccatgttctttagagactttattcctagattttatttcattttatttatttatttatttatttattttgagacagagtcttgctctgtcacccaggctggagtgcagtggtgtaatctcagcttattgcaacctccgccttctgggttcaagcaattctcctgcctctgcctcctgagtagctgggactacaggtgtgtgccaccatgtctggctaccatgttggccaggctggtctcgaattctcgacctcaaggaatccgccttcctcggcttcccaaaagtgctgggattacaggctttagccaccgcgcctgcctagtcctagatcttaaaatgttccaagaatccaggccgggcacagtggcacttgcctgtaatcccagcacattgggaggttgaagtgggagttttgcttgagcccaggagtttgagtctgtggtgagatatgattatgccattgcactccatactccagtctgggtgacagaggaagatcctgtctcaagaaaaagaaaaaaaaagttccaagaatccttgaagaatgtagtcagtgtgtaatccttgattcttggacctgcttcagcaataaatcttaggaaattttaaaaactgttgttttatatatattgttatttgagaatctcgtttttactttagagttgctttaggatataattggaaggatttctaaaagaagacagaactaaaatttaggaagaaaaataaattctatactgaatttattacagaaaaacagcttaccaccttagaaagccacctttgccattatttacctctggcctaaggtagtactttgcctctggtagatgtttagtaaatgtttgaatgaatgaataagtgagtaagtaaataaatgttatcctcttagttcacacttgctactgagtgtgaacttgctactcagttttgtcttcatttcctaactcctcccaaatttctgcaagtaatagtagaggattctaaggtattatttctattgaatggcatattgtaagtcacttaatctttttatttttctgcttatgaaacagttttgagggaagagtatgtggcttacaagatacgacttggccagaaatgtcttttctataacatactgaatgttaacctgacatggcacctgccctgaagctctaagtggcttaatggtcaaagtcttaatttttgaaccattaaaacaacatctgagattctggttacagaaaatctttagcttctttatttcctttcactctcacaaacccaataatcatttgtttcttgaatccaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaataggtgaagataaaagtgatgtagtttagaattagagtcactaaataaaactttagtaaaagaagcaatacatggccatggagtctggaacacagaaaagcttaggaaagaatttagtaaggactcagtccattttttgtagatattctgatatattcagattctgaatatatattctgatatagtcaaataatcagaaattctggttatttaaaaaatttttttttttttttttttttttgagacggagtttcattcttgttgcccaggctggagtgcaatggcgcgatcttggctcaccgcaacctctgcctcccaggttcaggcaattctgctgcctcagcctcccgagtagctgggattacaggcatgtgtgccagcacacccagctaattttgtatttttagtagagacgggtttctccatgttggtcaagctggtctcgaactcctgacctcaggtgatctgcctgcctcggccttgcaaatgctgggattacagttgtaagccaacgcgcctggccgaaaactcgtctttttaggagttctgtggcctctttggcaattattcatagataggattctcagtacttgaacccagaaccaggggaacgtgattcaatgggtggcatttccctgcagagatgtgatacatgatctagaggtagtttatgacacagtgtccatttgcatggatcctgcttttccctgagcctaaatatgctgattgcttggtggtaattttgagacagcccccggaacccatgttcagcatacatttgaatcctttggggggtgctctaaaattttaaagaaaaaaatgttcatgcacaataatagatgaatgctaatacatctcatttttttccttctagcttctatttctagcctaaaagctgaattagaaagaataaaagtggaaaaaggacaggtaagtcgtgagtttcaaattaattctatcagcaaccagtggttatttactgactcctactatgctgcacccaacgaataaaaaatagttaaggcatgggccctgccttaaggaacttttgtcttgtgggaagaaaaccacggggtaagggtgtgctggtgatttattgagagtgccctgtgtgtcaggctacgttaaactggaggaggtaaggctaagatgtgactgtggcctggagtttccagtgtagtgagaagataggcaaggcatggtcataacatgttatatgcttagaggtacagtagaaatatgtataaaaaacattacaaacaagagatgacattttctagctggcttagtcctcttagacatcattagttcctttcatagtaaccccattcaacttcctgacctcactgttccttgatttagagattttcacctccaccctgctctccccttccacacactgggctgcattttgcccaactgtgacatctcactgcagccttaagttccttgaccacaatctgccatccttccagctcttccatcggagtacctcattcagacctccagttctctgaacttcccctttcattctggtttcagcagcttcatggcttgctttctttcccctaggttgcatcttactggcctgcctcttcccttcatctcccaccacacctgtccctatggtctttgactccttgtcctgctgctgccctcacctgaccactgcccaaccttggactagtcttgctgtccccagctgctgatgccacgagacttggtgacactgcatgctcaagctgccagatgggcctccagtgttcctcatgcagcctttcatgtgtcctaagttgcgtctcttccattcctcacagtggcagtttcagagtcacctcacctcagccccctcactctcagcagatgctggcctcactcctcaggcatcaggcagggccaccttcagctactgggctcctcaattacaggttttccttttattcccagtcttttctttttcttcagagaatatcatgacctgcttctgaccacagtgtcattgcataggtgctttgactgagtatctccgacttttccagatgtccccgcgcagtgccgggccttgaacttctgcctcttgactgatcttttccattatgcatgaacaggctcaggtgtctcatattcagaaggaaaaagtctgtctttggattgcactcctctcccgagctaccactctttcttcctccctctgttgccacagtcttgatcatcatcactgcctgacttcccaggcatccctccacctgctgcagtctgcctcctgcctccactttgctactgatattgcaccagcagaaattaccagcgctcgaaataacatctcatcctttccattctagctgccactctttgagttcagacttcactctcacctggcttattgtaacagcctaactttccctgcctccaaaatttgtccctaaatcatctccatattgaaatcaaggtgatatttaaacattagaaacttgttcgcgtcccagtctagtggaaagccctcccgtagttccctttattttacaggatcaagtccatatccttagcccagccagagctctcctgcctcacacctctctgcctcagtgcctgtggctcccaacgtgctgtgctgtaggccagccgaacatgccactgttgctgcatgtgtttttagtgcgtgccatccattccctcttattggagtatctctccatcttctccccttgtcacccttgtctttgccctgtaaaaatgtaggagtcaaatgtcatctcctctaggaagtcctttgtaacttttctggcagaattaaatgcttctttcttcatcctttacatgtctgtttaccctgatttctccattttgaggccttagaatatagtaggcacctaataatggttaatgaaagaatagttcaggaagaatacagaggggatccacagagctgaaagggtgagaggagtattcccagtgtagcccgagtgtcttggtgtaattctccaggctctaggctcttttaggtagtgcactggggcccagagggagtttctgtgagtttcagctttttcctttttcacagttggagtccacattaagagagaagtctcaacagcttgagagtcttcaggaaataaagatcagtttggaagagcagttaaagaaagagactgctgctaaggtagtgttttcattagtcatttaattttaaaaagcagggctaagaatgcaggatcacatcttgcttgttgaaaaaaaaatattggtgctttgaagtgtcaccttttaaaaagttggcaaaactgacagcttgtgaaaagaaaaaacttaaacgaattgatctattccagctgggttaaatcttttctgccaggtctggaggcctgcgtcataggctagcttcagatagtaggcagtcagggccattgaccaagcctgggcactgcccagttagaagcactgctttgaaaatgtcattccatttgactgatgtatcaaatcctaagagagattgcatcaaaccaggtttgctgcctaaattttgatgagttccgttagaataaacgtgcatgttgtgggggtagtttcctagaaatggtcttagtgagctgagtggtcagacctgaaagtgcagacagtgttgctgaactgcttgtttttggaaaggctcccacacatcctgctggttttctgtaagagagactggggatagctggggcgtattcactaagtttcctggtggatgcttgactgtggaggttgtcagaggaagtcctgtatgtatccctgttggtgtgacagacaccgatcttagcagctgttttggtgattatcgtcactgtcaccagctgctgggggtgggggagggcagcactttaatccatttcttcctttggcttttcatacccagttcatctcaggacttagagcaagtagtctagatggcctgcacgcttgccctatagataaagagattggtcgtgtataggagtgcgacggatatccacccacctttctgccctagtagtaggtaactacaagttactggatttcctaagtaattcggccctttggcattaatcttcattcaaaacttgtattttttaggctaccgttgaacaactaatgtttgaagagaagaataaagctcagagattacagacagaattagatgtcagtgagcaagtccagagggattttgtaaagctttcacagacccttcaggtgaggcatttggggaaccacatacagagcacgaaggcagttttgggggacagaaccttgccgatccctgacttgaccactggcagtagctagaggtttagagactggctgctcctacctccaccccaaatgtctgactcatcattcaagccagaaacctggtgtgttcttcacacttggcccatttttctttttctgtatgccttgccaattttgcctccttatgagtaaagtactgactccttagcataccatgtaagactcttcccaaccaggcccacccctgtattttgctcatctctctgccttgttttacatgtttaactgcttgtggttcctcgcccacagcgtggtgttctgtctggtaagcatcctcatctcatcccctcctgactcctttctttcaaggctcagcgtaggtctgtcccctctgtggagctcttctaggtccctgagctgggctaaagtgcccctccctctgccatgctccctcgggcactctatgaatgcctgtaatgacacaatgacatttagaatattgtgctaaaactaagtttttttcccaatggaacttcggatttttttttttttttggagacggagtcatgctctgttgcccaggctagagtgcagtggtgtgatcttggctcactgcagcctgtgcctcctggattccagcgattctcctgcctcatcctcctgggtagctgggattacaagtacacaccaccaagcccagctaatttttgtatttttagtagagacagggtttcaccatgttggtcaggctggtctcaaactcctgacctcaggtgatccacctgcctcagcctcccaaattgctgggattacaggcgtgagccaccgtgcccggactggaactgtggattcttcaggattgggagtcaggtctcatttgtctccataatcccaacacattacactttaaaatcctagtctgggccaggcatggtggctcacgcctataatcccagcagtatgggaggctgacatggatggattacctgaggtcaggagtttgagaccagattgaccaacaatatggtgaaaccccgtctctacttaaaatacaaaaattagccgggcatggtggcgtgtgcttataatcccagctacttgggaggctgagacaggagaattgcttgaacccgggaagtggaggttgcagtgagccaagatcatgccactgcactccagcctgggtgacggagcaatactccatctggaggaaaagaaaaagcaagcaagccaggtgtgatggcaggcacctgtaatctcagctactcgggaggctgagacaggagaatcacttgaacccgggaggtggagactacagtgagccgagatcacaccattgcactctggcctgggctggcctggatgatgagcaaaactctcccccccaaaaaaaaatcccagtccgttacacggtagctttggggaattatttttaaaatttttaattgttcttgctgtctccctttgaagtgactagtactctggtgagttaatctgctacatctcagctaaaccagtcaaagttcagaaaatctaggcaggagccacctgtagttatctcaccattgtttctccaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagcggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggccattggctactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggatcagtgaaaaacattagtatacgtttttaaataggctaatttttcaacttggatcattaggcttacgtactacttgtttcaaatgtgtcaaatacaaaaatggtaactaggttgacagatactttgtatttttcttttgaattcagacctggaatgtaagtaagtgacaatgcttatggaaagccagttagttagaattggaaatctgtcttgtcattttacaagcattagattcctttcctgtgtgaagaaagcctcagtgaaacaggtctttgccataactttatgaagtgctacagaaagcacaaagaattgattcatgttcatcaatacctgctgagagtactgtcccaggaatatccagtggatggattcatcatccaggaggttcaaaagtaagatggttttcaaatcatttttgagactggttgcataacagcagggtacctgaaagagccttctgggagttagtgaactaggtagattgttttgttcacataacgccaccatcaacttaaagtgaattgtctttgttataaatgaggtcactatggacttaccctaaagatcttctgtacttctgtcttccataggacaaatgataagtactacatacctcatctcttgggttattattgtagtcttgcattcatggttatgaatttaaaaataaataccaattatggaaatagtactaaaggcttgccgcacatgaaacattattttaattggtttaaagtccctttataaagagtgctacatggtttagataaaggaaacatataactattgagttacaggggattttattaattataaaatgcaatcaatttaaattacgtaggtttaagactagtcccttggataagccccaagcgaatttgtcttcagattattaaaattagtgctgtaaatcagggtgggcaattcacagcctttctgaactgactgaactagagcttgcagtgaagtgttctgctgagactgagcaccttacagatatttttctccagaagatggtgctgggtaataaaatcatcacaattagggaatggttagtggtctctactgtggcaaatgccaactgttggaattcactttattgtagaaaaacccaaactgagactcttaagttttgtttagcaatgtgtttctggtatgaaacaaactactgtgtcactgtccaggtaggaaacaattctttcaactgggttttcagcataaatgggaactgatgtagaaggcaggatttagcccttctaggcaaaagaaaagctcagttgggtttcacgagtgttcctgtgcttatattcagtctgtgcctacatgttctcatgcatgtctaacctgatttacctcttacctgtaacctaccttatcatgtggcttttaattgacagtcactcagccatttctaagcagatatagtagtacctttcagaactcacattggcaagtgtaaaaagatgacttaaggtgaagtgaggacaaaatcacattctgcatactaacctatttttttctccctttaaggtgctaaacttgcacctcatgtccactcagtaacaagtattgggacgtagagcacagcctcactcagctctgaaaggtaatacagcttgtgaggaagtgagccagcagtggcctttgcaattgtggatcttgagctctgctctcagcagatttcaggtgtaaccatttgttaactgtactgaaggtgtgtcctcaagaagaaagtgttcaaattaaaaaagctgctgccaagtacactgtgtggtcttctcctttgaatcctagggttctatccctcttcagagtcatgtttctggtgctgctactttaaaacacagctcacaagaataactaacttgctcaaatatggagaaaactcaatagggttcagggaggttctggcagtgtgcagtgtgaaataatcctgagtccttgctgaacacaactgtaggcttgagttataaagcacattccaaattttaaataaaagcatttactcaattattataaaacaacatatttaaaaagatgaaccacaccaaaggtcatcaaaacacctttttataaattagataattctacctgttttacaatatgggtttaagccttcaatggtgttcagttcaggtgtgagtcagctcctggtggtgtcagaagtttacatgattgcggatatcattgatttgcttcaccatttcccttatatgttcacccctgtaaaattgtaaagtcactcacttttggaattataataaaccatttatatggattcttaagaatttaaactggtaatgttgaaacatctaagaactgctttgctaaaattaacagctgaaggtttcaggtggatagcaatagtgttcactattcatttaaggtggcaaacggtgcaagtactggaaatatttttgaacataattactgtaaaatacctttggccacacaacaaaatcatgttactagaaggtcatccctttcaatcctcccaccatagtcatttcttaagtccctatgtatcatgtggctctcatcccagtaattacttgacatgcaaataccaagattcaggtttctattaagacaggttgattctggcatactgtaaaggaaaaactatctcacgataatagctgattggaagtatttacttactcctctttcaggatggactgaatgcactttcgctggtaggcactgagaataatggtgggttttggaagactcaacaccttctccatcttttgctgttgataatcctttttcatagtaaccttaagtattaaaataatagatattttggcagtggtttgccacacattttcacagtatctatttgaatctgttctttttacatttttgtaaaattttctgtagaataagtgctttaagaaaaattaccaaatttagctagtttggatctattcctacctgtttgatggcattgcccaaatgtcgaagttgatcaggtatcagctgtaattctttcttcatgtctcgctcactatcagagagaactgggagctcagagtgaaaactgtgaagtagttttttcatcctttagaaaaggcaagcaaacatctcaatttaaggtctctactaattaggagaaacataatcacaagctcataattcatgaatctggtgtttctgaagtaggccccataggaagggttaggggagagcctcatgttttccccaacatatacttcagaggagaggcagggggatcagttcagttccgtaggtatgtaagcacctgccaatgcccattttcttaaatatcgttgttagtacctgactaggtaactaaatgttatacagcccactgacctgttcatgatatcctcttgtttttctttagcttcctcatatttgtcagctaaacgctcagccatttcccgcagacttttcctaatgatgtaagacacaagagactcttgaggtccaccccttgatgctgaaaccacctaatgtggctcagcatcttagggtgagaatatggttccagtcttactgacctattgtattcttcttatttttgacacttacctctcttctcgacaataactgagatcttctagttgtttctttttttggtcacataataatttgaccctttaaaaacaaaaagaaatagagtttattcagaagccaggtctaggctaccatacagcatcagctaccagccagggatcgatggtttgtgaacacaggacatcatacctccgctgaatctcctcctttgccaagtcctgtttgagaatgtactgctctctgaacacctgggtggctctgctgaggagctgaaggcattcttcaggaggaggggctatgtccttttcagaagctcttaaaaacaaagtttctacctttattttccttagctgagtaaaacaactgaaaataaatagactcaagtcacaggtgctttttaaactttttatatttttaatttatttatttgagatgcagtctcgctctgtcacccaggctggagtgcattggtgctatctcggctcactgcaacctccacctcccaggttcgagcaattcttctgcctcagcctctcgagtagctgggattacaggtgcccaccaccacgcctggctaattattgcatttttagtagagacagggtttcaccatgttggccgggctggttttgaactcctgaccttaggtgatccgcctgcctgggcctcccaaagtgctgggattacagctgtaagccaccgtgcccagcctaacttgagacgagtctcactgtcgcccaggctggagtgcagtggtgggatctcagctcactgcaacctctgcctcccaggttcaagcggttctcctgcctcagcctcccaagtagctgggattacaggcatctgccaccacacccagctaatttttttttgtatttttagtagagatggggttttgctgtgttagccaggatggtctcgatctcctgacctcgcgattcacccgtcttggtctcccaaagtgctgagattacaggtgtgagccaccacgcccggcctagcctaacttctttttaaacacttcctgtttatcattctcaggtgccacttccctcctgctccccattcactagctgatcaaatatatccagtttcttccaaatttatcacagtaaaaagtatatgaaacagatgaggacagaaaggatgcacagtaattctgaagacagaagagaacccattcataaaaccgctatgcccaaggttgcatacttcaaaaatgctggattggcaacactacgttgcaaaatgcttctaatatgcttttcaaaggaatctggggtttcagccagaacacggaggggagactctgccacttcaacatcttctcgagtacaaagcaggggaggagacgctggatggactgtacttctgcaaaataagtaagtaaattgaattctaccatggagtgatttactgtattacaggaaagcagaaaccacattaatccagaactttcagaatataaaataaagtgtaacttttgtaaaagtgcaagaatgcatgttttccaccttgaaaaggtcactttgggaagctacacccttattattccaatgcccctgatttgtgaaagcatttctgactgccatttccagttcttttctaaaagatcaaggcagcacaaacacctagcatggattcttggcaaaggacttgaaagccagtttataagccggagccacaaacataaattacttatttgttaggtttagagttgatcaaaaccaatattaagccaagaaactgctgtatataccatattggttctatataatttcatttctaaaaactattcagtcaagtgcaaatactcaaacttcaaaaagagcttaaaagatctcacagacttcggcagcatggcaagtgacttactctgaaggcaacaattctaacgtgaatgtttggttgggcgtggtggctcacgcctgtaatcccagcactttgggaggccgaggcaggtggatcacttgaggtcaggcgttcaagacaagcctggccaacgtggtaaaactgtctctactaaaaatataaaaatcagctgggtgtggtggcacacatctgtaatcccagctacttgggtggctgaggcatgagaatcgcctgaacccaggaggcggaggttgcagtgagctgagatcacaccactgcactccagcctgggtgacagagcaagactctgtctcaaaaaaaaaaaaaaaaaaaagtgaaagttcatgaaatagcataactttatagacaacttgtatttcagggagttggcagaaatatgatctgaaagtatccagataattggcctggcacggtggctcatgcctgtaatcccagcactttgggaggccgaggtgggtggatcacctgaggtcaggagttcaggaccagcctggccaacatggcaaaacctcatctctactaaaaatataaaaattagctgggcatgtggtgtgcgcctgtaatcccagctactagggaggctgaggcaggagaatcacttgaacccgggaggcagaggttgcagtgagctgagatcgtgccactgccctccagcttgggcaacacagcaaactccgtctcaaaaaaaaaaaaaaaaaatatccagacaattaatgtttatttttcccctttgggattcatatttattctgaagtaagctagtgtgactaggttttattttactaaatgtactgtgggtgtttaaaaagtatgctgaggtaacttacaggtaattttttctccagtgattttattatttttgtttggtcttgctagcttttagtgccttcagtgtaaataacacaaaatttatatttatttttacatccagatagtacaacttaatcaagcttcaaagactatggaagatcctctaaggacagtaaactactgccagtattaggaatttatgtcagcatccagaggtgcaagctttgaacggacaaggggtgggggtgttgtctagtgtttgaagctccagtgacttttgtttttggtactcatattcctacatttatgtaactcagaatgatcttccagggctgttggaaaaggaacatagtgattacagcttaattatctgagttccttaaaggagcaaagactaagagttcagcttttttgtttttttttttaaaagacacagggtcttgctctgttacccaggctgtagtgcagtggcatgatcatggttcactgcagcctaaaactcctgggcttaagcaatcctctcacctgagcagctaggactacagatgtgtaccaccatgcctggctaatttttttgttttttgtagagatgggggtctcactgttttgcccaggctgatctcgaactctgggcctcccaaagcattgggattacaggcatgaaccaccactgcacccagcctgagttcagctttattccagtttacatagtctacagtgtccctcaggctggcagagatggagaaattaaagagtatgagtatggacttctgagtcaatgagacctgcatctgtatcccagctctatttgttacctgtgacttcagcatttactaacctctcgatccccgtttccacttttataaaatggaaatgacagtgccttccttacagggctgccctgatgattccaggaggcagtgcgggtacgtggcttacttctgagcttggcgtatggtcacagcttgataattattactcatatcgataatggaatttggtattcaattttagtattttttctccacactctgaagaaaagctcctgactctcagctaggtgcaggggatgccagaaactatacctacaatgaaaccttatagagatgatggcaggaacagaaatatccatccttccaaccctcaagtcagaagccaaagtataaaccacacatgtatagcttcaagttggttactgagtgcattttcccaacttagatattgcagaattaacaagagctgtgtggagaatataaaatgggacgtacaataacggccatatgaggcattcataggtactggtgatgcagatcatcgtgggtcccagaatgtcaggtacaatccaaaatcctcgaattggagctggctgcctggaaaaacacagtcatagttaaattacaaagcagcaaatgcaatggaaccaagagcaaagacatgacaggtccgcggccttctcaggcctgggctgaagttgcttgggacatcctatcagtaccataacctcaaaagtggtggcttggaaacctttaatgcagctccacactaaagtctagagcccatgtgactaagtcactcaggaatccctaactgtagcgtgctgctgactgtaatctcaaaagttacacgttacactgaagatctctccaacttgcacataagccccagctatctttgtttgcctagcccagtgctaacaaattaagtgcttagaaactgttgaatgaacagaactaccgagtctctctcaatgaggcccaatgtcaatgtcacaggaaatcacttggcacgcacagcgtgtatctctctcagtcttccttcccacttcagtgaagacactggaaactgagacctcagatgggaactgtcattctgccaacatgctctcctagcggctcccatgcccatcccacctgcatgcctacaacacacatctgcccccgaatgtggatgccgcctcctctcacaccttctgaaaattgtaccatcaactgtgtcgtttcaaaatctccctattatctacttcccctcagcttgcaaactcatgtctcttccatttaaaatactctcatttcaatataatgtccagttccccttaacctattctttctcgccatccctttagaaccagcagtctttaaacagcagttgaaaacactagttccccttccatagctcccatttacctttttggacaagacatggagacgatatctggaaggttgtaaactttaactttttattatcagtgtgaaatctacacactactgggctatacactatgtaaccagtatccaggtcaagaatcaggacactgcagggggcctcagggttcccatgcgaccttccctggtcatagcctttcactccccagagaagtagccgctactctgacattcataatatcatgtctttgctttgctttatagttttcctatctatgtattcactcctaggcaagactgtttaattttacctgtttctgaaattgatataaatgggattttggggtttttttgagatagggtctcactctgttgccgaggctggagtgcaatagtgcgatcacgactcactgcagccttgacctcgtgggctcaaacaatccttccttctcagcctcctgagtagctgggaccacaggtacatgctaccacagtggctaatttttttttttgtttgagacggagtctcactctgttgcccaggctggagtgcagtgacatgatcttggctcactgcagcctccacctcccagggtcatacgattctcctgcctcagcctcctgagtagctgggattacaggtgcccgccactacacccagctaattttttttttgtattttagtagagacggggtttcaccacgttggccaggctggtctcgaactcctgacctagtaattcgcctgcctcagcctcccaaagtgctgggattacaggcgtgagccaccacgcctggcctcacctagctaatttttaaatttttttgtaaagggtctcactatgttgcccaggctggtctcaaactcctggcctcaagtgatcctcctgcctcacctgacaaagtgctgggattataggtgtaagccaccatgcccagcctacatgggattttattatgtattttccttgttcacttttctttttttttttttttttttgagatggagtctcactctgtcacccagactggagtgcagtggcatgatctcagctcactgcaacctgtgctgcccgggttcaagcaattctcctgcctcagcctcccgagtagctgggattgcaggtgtctgccaccatgcctggctaatttttgtagtttttagcagagatggggtttcaccatcttggccaggctggtcttgcactcctgaccgtgtgatccacccacctcgatctcccaaaatgctgggattataggcgtaagccacagtgcctggtttcactgttcacttttcaagctggtacagtttgctatccttctcattccccaccaagcgttttccctgtggtcctctgtattgccaaacctagattatgtctatttcttagtgtatgctatttgtctcatgtctgtgtatactccatgtctaacagagtgcttatgagatatctagtaattgatgaacagaataaagggaggtatctagaataccttccaggtttctactggggataactggggtgatatggcacccttcagaaaaatgggacacaggagagagagcagatttggaaagacagaagatgagttaaggggacatctggagttttatgttcctataggatatccaagtggaggagcccagtaggcagctgggtatgtgaatctggagttcagagtggtctgggctagggcgatatggatgcgggaactgtcagcactgaagccatgattacggcagaagttactcaggaaaggacctagaaagaatagagaagacccaaggaaagagttgtgagcattacttataagcagtgagtagaggcagaggaacccgcccaagaaggaaacttgagaaaagggctgctggcgggactgaaggagaacctggagggacagacgtcaaggatgccaaggagaatgtgtttcaaagaggagacatgggcaaccacatcaaataaacacagcaatgcagtgaagggcagacacagtctctgctctcatgaaacatatacattccggtagtggcgacagacattaaaaaaatgcaaatataaatagtgtaatatgtgctacaatggataagagaataggagagccccaagttagactggggagtcaagggtgttctctgtgaagaagtgacattaagatcagaaagaagggtaggagttagccaagagaagacagcaagctggggctggggctggggctggggaaggaccttccagtcaggaaacagtatgtcgagtggccctggagaggagaaagcttctgatgagcaggacactcttaggggagaagtatcacgtctgcaactttcaaatgactcagcagtgaatactgtggatgtgagtgtaacggatacaaacgtatctgaactgctgaaatgaacaattgttttctgatatacaagggagggagagtccttacctgcagggcaatggcttcgtacaaaggatgtgttcaacaaagcatttctgttctgtagagagttcctgtaaactatccttatcttcttcatctaccatggaagacattacataaatgaaatgatgcttagacaagtctccaaattaaaatgctaatgatattgggttaaatgcagtgaggttcttgtctgaaaacattgcttctcaagtactatgcttttctgacataggcatacgctttcccagggggtctagatttccgccccaagaagtaggattttccttcgtaatgtctctgaatgcaaaaatgtttcactaagaacagtgaaatcattctcttctagggtgctgcttacccacactgattttattttcataaaggttgagtatcctttatccaaaatgcttgggatcagaagtgttttggatttcacattttttttttggattttggaatatgtgcattatacttagtagttgaacatctcttatctgaaaatctaaaatcctaaatgctccaatgagcatttctgttgtcatgacagcactcaaaaacttttgtagctcactcaggttcaaggatggaaaaaagaaaagttttggatttcaaatttttcagagtagggatactcaatttataacagctttatttttttttggatggagtctccctctgttgcccaggctggagcgcagtggcccaatctctgctcaatgcaacctccggcttctgggtttaagtgattctcctgcgtcagcctcctgagtagctgggactacaggtggacgccaccacgcccaggttttagtagtagacagggtttcacggtattggccagactggtctcgaactcctgaactcaggtgatctacctgcctcagcctcccaaagtgctgggattacaggtgtgaaccaccacgcctggcctgtaacagctttttgaaacgtaattcacagtaccatacaagtcatccatttaaagtatacccattaaagtatacaattcagtaagtttttagtgtaagaattgtatacctggcagggtgcggtggctcatgcctgtaattcccagcactttcggaggccaaggtgggtggatcacccgaggtcaggagttcaagaccagcctggccaacatagcgagacgccgtctctactaaaaacacaaaaattagctggacgtggtggtgggcacctgtaatcccagctactcgagaggctgaggcaggtgaatcgcttgaacccaggaggtggaggttgtggtgagccaagatcatgccattgcaccccagcctgggcaacaagagtgaaactccgtctaaaaaaaaaattgtatacctatcattaacaatttggaatattttcatttccccaaaagaaacccacataaccattagcaatcactcctcagtttctaccaaacttcccagacctaggcaactaatctactttctgtctctgtacatttgtctattctggacatctcatataaacagccatacagttgtttgtaactggcttctttcacttagcatctgttcacagttcatccatattggagcatgtatcagtacttcattccttttcattgttgaataatactctgttgtatagacacaccacattttatctatccattcatcagcttatggacacttgggtatgtggcttctgggctatgatgaataatgctgctgtgaacactcatgtaccagtatttgtgtggatacaggtcttcatttctcttggaaatatactcaggactggactatcaggtacatggtaactctatgaataatcatttgaggaactgccagattgttttccaaagactgtaccattttacatttctataagcactgtataaaagtccccattttttcccacatcctcaacacttgttaatgtccatctttttcattttagctatactagtggatatgacgtgatacctcattgtggttttgtggtatcttatttccataatgactaataatgttgtacatctttttatatatatgctatttgcccaactgtatcaaatgctaagggttctttatattgttctccatacgagtccattatcacacaaatattttctctcattttgtgggctgttttcccttttgtaatagtattcttgaagaaaaaagatttaaattttgatggccaggtgcggtggatcacacctgtaatcctagcactttgggaggctgaggtgggtggatcatttgagcccacgagtttgagaccagcctgggcaacacggtaaaaccccatctctacaaaaaacacaaaaattagctgggcatggtggctcactcctgtagtcccagatactttgggggctgaggcaggagcactgcttgagcccaggagttcgagactgcagcaaccaatgactgcaccactgcactcccacccagacaacagagtgagaccctctgtctcttaaaagaattttttttttttaaatagggacattaccttggattatccgggcagacttaatgttaccacaagtttctttaaaagtgaaacagagtgatacaacatgaggactcaacccagcccactgttgctggctgcctttgaagatagaggaagagactacaagccaaggaatgtggcaggagctgaaaaagggtaggaaatgcattctaccctagagctttcagaaaggaaaactgctgtgccaacttaagcccagtgagaaccatgcaggacttctaacctacaaaactataagataacaaatttgtcatgttttaagccactaagtctgtgatgatttacaacagtagcagtagaaagccaataacggattcagtctttttaccattaagcattgtgttggttccaagttttttgtagatgaaaagtttcctcactagtttgaggaagttcctttctattaagtttgttgagtatttttaacatgaaaggctgctagattttttttaactgctctcactctgtgaataattggtattaattcttttttttaatttattttttattttcatttttgagatggagtcttgctctgtcacccaggctggagtgcagtggtgtgatctcgactcgaatacagcagtctctacctcccaggttcaagcgattctcctgtctcagcctcccgagtagctgggattacaggcatccgccactatgcctggctaatttttgtatttttttttttagtagagacagggtttcaccattttgaccaggttggtcttgaagtcctaacctcaagtgcctcggcctccaaagtgctgggattataggcgtaggccactgcacctgaccggtattaattctttaaatgtgaatccatgtggtcctcagcttttctttttggatagttttgattactaatcaatctctttgtgtcagtttttgtttgtttgttttgagacggagtcttgctctgtcacccaggctggagtgctgtggcacgatatcggctcactgcaactccgcctcctgggttcaagcgattctcctgcctcagcctccagagtagcagggattataggcgcacaccaccatgcctggctaatttttgtatttttagtagagacggggtttcgccatgttgactagactgttcgcaaactcccctgacctcgggtgatccacaagccttggcctcccaaagtgctgggattacaggcgtgagccactgtgcctggcctaacttttttttttttttgagacagagtctcgctctgtcgcctgggctggagtgcagtggcatgacctcggctcactgcaacctccatccctggttcaagcgactctcctacctcagccttccgagtagctgggactacaggtgtgtgccaccacacccagctaatttttgtattttaagtagagacagggtttcaccatgttggttggccaggatggtctcaatctcttgacctcatgatccgcccgccttggcctcccaaagtgctgggattaaaggcatgagccactgcacccagccttttttttttttttttgagacggagtctcgctctgttgcccaggctggagtgcagtggcgtgatcttggctcactgcaagctccgcctcccaggttcacaccattctcctgcctcagtctcccgagtagctgggactacaggcgcccgccaccacgcccggagaatttatttttgtatttttagtagagatggggtttcaccatgttagccaggatggtctcaatctcctgattttgtgatccacccacctcggcctcccaaagtgctgcgactacaggcgtgagccaccgcacccggccttttttttttttttttttttaaagcaaattatcccagaccctgattgagtcagttttggtagtttttttttttcttggaatttgtccattccatctagattatgtaaatggcatacatttgttcataatattcctttataatcttttatttctgtaaggtcaatagtaatatccctgcttttattcttgattatagttagtctagctaaaggcttgtgaaatgtggttgatcttttcaaagaacctttcggtttcactgattttctctatcatttttctattccaaactacttttctgaaatctattaaatctatttttcctctgaaatctattaaaagtgcagagagttagtaaactcacctgatccaagaaatttgtgaagtttatgaatccaagttagcccaacactatgtacaccagcttcatgagtacagtgatatcttgaaggacacttgggatctgcaaatggaatgattaatgatacaaaggtagccagtggataactaaaaaaatttacctcaaatttgttggctactccacattagcctacaaacgcatttgttgatggaaggttttataaaagactttcatattgttaggggttttgaaattttaaaatttgaattcaaatttcaaatatattttaagtacagatatacctcagagatactgtgggtttggttccagaccattgcaataaagcgaatacagaaataaagtgagtcacacaaatcttttggtctcccagtacataagaacgttatgtttacactatgcagaaagttatgtttatactagtaggtacgcaatagtgttacgtcaaaaaatatgtacataccttaaccattttttattgctaaaaaatgctgacacagagacagcacgtgctgtttgaaaaatggtgccgatagacttgcttgatgcagggttgccacatctttcatttgttaaaaaaaaaaaaaaaaagcactgtgaaccacaataaaatgaggaggtatgcctatgttttaaaaagtataaaaaatggctgggtgtggtggctcacgtctgtaatcccagcactttgggaggccgaggtgggaggatcacaaggtcaggagttcgagaccagcctgatcaacatggtgaaaacccgtctctactaaaatacaaaaattagctggccgtggtggcatgcacctgtgatcccagctactcgggaggctgaggcaggagaatcacttgaacccgggaggtggaggttgcagtgagccgagattgcgccactgcaatccagcgtgggcgagagtgaaactccgtctcaaaaaaaaaaaaaaaaaaaaaaaactcaatccaaatgttattttctaaatatgaacacaatgaggttcaccaaaacataaatacttgctggcaagtaactcatttatgcttttctctgtgcatttatttagttcttcaaaagaaaatggtggttaaaatagcagctctgtagaaaacctatgcttatgcttgcatacatcgacttaaataaaattgttgaagcaaatgcacttctacagcatagttatcacaaaagactttaacacaacggctcagggaacagttctatcagtgtagtaaggtgtgaaatgagaagtgaagtttcgtatgtcttcataatgttgacttacagatagtttcaaaggttattttcagttttggatgctctttttgtttgacaatcatttataactaagaagtatgagtagttgttatacaattttaattaactgattttgaaacaaaaatttctgtacctcctttgagccccagtatcagtaagacaatcctgagactaaaagataaactactgaatacctattattatgtataaatatttatctctgtaactcaatatttttattattaatattaataataatcttattggccgggtgtggtggctcacgcctgtaatcccagccctttgggaggccaaggtgggcggatcacctcaggccaggagttcaagaccaacctgaccaacatggagaaaccccgtctctactaaaaatacaaaattagccaggcgtggcggcacatgcctgcaatcccagctactcgggaggctgaggcagaagaatcgctcgaacctgggaggtggaggttgcggtgagccgagttgtaccactgcactccagcctgggcaacaagagcgaaactccgtctcaaaaaaaaacacaaaataataatgttattaaactaaaacaaaatacagagataaggtatatattaaagctgataaaatggcaacaataacccataaaacccctaaattaaattttcctttaatctaacagtctcactttgtggttagtgactttatcataaattaatattctaaagctgatatattatttttctgtcttatatattgaggttccataaaacatcttagaaaacagcattctgctataaaaagtttaaaaaaccctcatctatgggaatcatctgtttgcataattaaaatattgaaaattttcttttcatttgcgtatgttttaagacttaaggctcaaatcatctcattaaatctaacattgttaaaatggcttttcaaaacctgtagtgctaacatcaacagaaaagtcttaacactggggtgtaaaacaaattgattactaaaaagagccaacatttacttaacaggaaatttgttagataccaccctatgctatactgtagccatttcactttgtcactaagaaatctggtgtgcctcagtgattataatatgccttgttcagcacaattaggaacaagtcaaaaatttcttagtttcacatatgaaaatgttactctcattagaagaaccaagaaaaggctgggcatggtggtttatgcctaaaatcccagcactgtgggaggccaaggtggacagataaggagttcgagaccagcctgaccaacatggtgaaaccccatctgtactaaaaatacaaaaattagccaggcctggtggcgcatgactataatcccagctatttgggaggctgaggcaggagaatcgcttgaacccagggggcggaggttgaagtgagccaagatcgtgccattgcactccagcttgggcaacaggagcaaaactccatctcaaaaaaaaaaacaaaaaacaaaatacaaaaaacaaaacccaagaacaaaacgtccacgtctacacttaagatttcccaaagatatacgtatctatatgaggaaaccaattagtttatgtcactttacttcatttggtctgtttcctcatctataaaattcttagacaatataaatctcaaaataccttaattagacaaacccaatgtacactctttgctggtttgttatgtaaggaattctgcccccttaaatgttttgcctatactttagtacagagttgaggccgttattaccagaactaggcaaactggctaacaagaactgtaaggagagtaggtcaaactgctacaagattgaaatcctcctatgttgcagtgaatgacacgatttcattcttttttaaagccaaatagggctgggcatggtggttcacacctgtggaccagcactttgagaggctgaggcagaaggatcactggagctcaggactttcagcttggacgacatggcaaaatcccgtatctaccaaaaatacaaaaattaggcgtggtggtgcacacctgtagtcccagctactccagaggctgaggtgagaggattgcttgagcctgggaggcaaagcagtgagccaagatcacgccactgtactccagcctagatgacacagtgagatcatatcacacacacacacacaaaagccaaatggtattccactgtgtatacaatgccacattttaaaaatccatttggggccaggtgcgcggtggctcacatctgttatcccagtacttctggaaggccgaggcaggtggactgcttgaggccaggagtttgagaccagcctggccaacatggtgaaatcccacctctactaaaaatacaaaaattgccaggcgtagtggctcacgcctggaatcccagcactttgtgaggtcgaggtgggcggatcacaaggtcaggagttcgataccagcctggccaatatggtgagacccccgtctctactaaaaatacaaaaattagcagggcgtggtggcacatgcctgtagtcccagctactagggaggctgaggcagaagaattgcttgaacccaggaggcggaggttgcagtgagctgagatggtgccactgcacttcagcctgggcaacagagcgagactccatctcaaaataaatgaataaatgaaataaaaatataaaaattagccaggcatggtggtgggtacctgcaatccagctacttgggaggctgaggcaaaataatcgcttgaacctgggagatggaggttgcagtgagtcgagattgcgccattagactccagcctgggtgacagagccagacaccatctcaacaacaacaacaacaacaacaaaatccatttggtctgtcgatggacacaggttgattcagcatcttagctgttgtgaataacactgcaatgggcatgggagtgtaggtatcccttcaacctattatttcctttccttttgacatacccagtagtggaactactgaataacatggtagttctacttttgaaaggaccaggaaaaattcactattaggaatctggtgatctggaccaaagaccactattttaaaacttgggaaatttgctcagtctgccttagacaaaaagtgtactatagtgactaaaaagctaaaaaaaacccagtcaactttttaaaggctggaaccacagaacaaatacattacataggaacagtctatgatagtcttagtataaaaatcatgggaaaaaagcactacatttattgaagagcttacctctatgaagtttgactggacaagaaaagtcagaatcaaaagggtcatcctctccagatgccagtttcaaagcaagctccaactcaacacattcaaacacatacagagaaggaatgaggtcaatcctggaatcccaggacttttctgactgtaaaaaaaagtgttgtaattttgatcttgcatgttaatttgaaaatgtacacaattaaaaacaggcaaaaagctgggtcagggccgggtgcggctgttcttgcctgtaatcccagcactttgggaggccgaggcaggtggatcatctgaggtcaggagttcgagaccagcctggccaacatactgaaaccctgtctctactaaaagtacaagaaatcagccgggcgtggtggtgggtgcctgtaatcccagctactggggaggctgacgcaagagaatcgcttgaactcaggaggcagaggttgcagtgagccgagatcacaccattgcactccagcctgggcaccaagagcgaaactctgtctccaaaaaataataataaaaaataaataaaaaaattgaaaaaaaagctgggtcaaacagtactttcaaattcttaattccacctctatcctaacagtgcactgttattctgaagacaaaacgtctctcttcctttaggaagatgtttgtgaaaaaagccaattcagtgattccaaggctctttgtatctgtccctgaagattgcaatatagagaccagaaagtaacatgcagactggtggaccaagtaagttgggcaaccttctaacttctttccacttagactgctaagtgtgcttcagctacttttttaactgtttaatttccaaaatatcagaagttccataagtaagttaaaattccttctcatatattaagcattcatattgggtcaggaactatgccaggtgttgaagatacaaacaaccacagcagcctgcacttaccgtgtggtcatcttcttcttccccttctagcacgacacagtgatacagcattcctgattcagtagcgatcactaagatattggggacacagggtaagcagagtacagcacacgcatcataaccatagttatcttcagccgcaggatgcatgggcaatggacccaacagctttccaatatttccagggctaaagaaggagtaaaaacatatttgggaaatgttgacagtatgcatgctcatcccataaaaccattctttgactttgttttcctccagctatcataccttcattataaatgtagtgtattcccaatactccatcttctcgctttcccactcagatcccaccactctgtgtttctcaaccagagataattttgccctagcggacagtggcaatgtctgaagacattttggcttgtcacaactggttgtcacaatgtggggggaggtattagcatctagtggttagaggctagacagaagccgctaaacattcccgcacagcacagcacctctaaaacaaacaataattcagaccaaaatgtcaatagtacaaaggttgaaaacccttgccctaaatttactatggtttatgctttcaccactccactgaagctactgtggcaaaggtcacctgtgagatttgctaaatccaaaatgcacttaaccttctgctgcatttatcactggttaacgactactgctactcaacagctgtaacaattctttcttgtagttctctcttcctacctctttaaacacaattttctaacgtccttttctaatttctgtctcttaaatattggtgttctccaggattctgttgtatgctttgacttttttcaaaatacacacttaaatgagagcctgttaaactatgcctcgttttaactaccatctatattcaaagactaccaaatcctttcttctaaaatgtagcttctcttcaaggctttggatccccatattaaatttgatttgacaaatacttattattgagtgctagatgatactcccagtgaatgatggtttagttgatgaggcagacatttaaccagaattactataccatgtgataagtgcaacaacagaaggatttatggtgtacaaaggaatgacaaaaagatacaaagataatgaagaaagctataaaaaataaatgagaaaaatgagaaagaatgatttctgggaaggggattgttgagcattccaagctagagatcagtttatgcaaagtcctggaaacatgaaagacaaagaactaagaacaagaaaacttatttagtatgatgggaggcaaagtacaaggtggaaggcaacggcaaaatagctagacagacatccaggactggcttatgaagtacacagtcttgtgtgctatgttaaactatttgaaatctatctgccgggtaacagtatatcactagaggtttaaatcaagcgatggagcctcactttacaaatcagtctggtattagggaggaagacatggaagggtccaaaatgggatttggggaaactatttaagaaaataagccaggcagatggtgaagtaggcagatgatgcagttctgaagcagggacagaggaatgcagagaagggtgtataatcaggggtgtccaatcttttggcttccctgggccacactggaacaattgttttgggccacacagaaaatacactaacaatacgtgatgagctttaaaaaaaaaagaaaagaaaagaaaatcgcaaacaaatatcataatgttctaagaaagtttacaaatttgcgttgggctgcattcaaggctgtcctgggctgcgcgcagcccgtgggttggacaagcttggtgtatactttcgaaaaatttaaatcacaaaatcaatagaaatttgggactgatgaaatgtaaggatgaagaaaacttttgggttttgggctaacgttactaggcagatcatggtttggacaaatgagggctcagcagcaagaggagaaagggtaagggaaggtactaaagttaccacaaaatcctcctgagatcatgtgtgaaaggcagagaacatttctgccaaggagaatgcactcaacagtgaatcctcaccattctgtaacctaccgagctctttcatctttctaatctttatggttttgcgtactctcttctctctcctgtacccacttctgattctgtctagtgaatccttcaagttcaagcttttgtaatagcatttccttaaagtcttccaagatgagcaggcctactcatttactccatcacactcctgaagaacccggtgatgccctgagcacatgacactgtactatagttactggtttagttgtatgcccttctggtagttaaggaaccacatggcaggaaccttgccttcaatcttgtatttccatcttctgccagagtgggtcctgaataagtatctgttaagtcgatttacaagcgaataaactctaatgctcagcccttagccttatgcctctgcagttttccctcaaattcttatcctgtatagactctctcaccatgaaagatgattctcatacctctattttaattcttcttgtctgtcatcatcctgtatttccaactgtccatggaatatttccattttattggtccaatactatcttacactgatttacttagaaataaatcttctcccccaattagcagcctttactgacctgtttctgttcatggcatactcccttatccaaacagtaactaagtcttatttatccttcctttgttgttatctactgtgtttcatttttccctctgttctattaccacccaagttcaaactctcataaatgacaagctcaattttgcaaaagcttctttaaaagtctctgtcccagtcccctccctaaccaattgttttgtccttctgttcagaaaccatcactggcttcctactaccctattcctacagaaaaaaaacccacactcactcttttaacgaggtatttttaattccagcaaattttctcgggacagatactccagctttatcacttaatgctccctacatgaatcctcagctctagcccagaatgtctaataaattaagcttgaatgacacttgcacttgcttattttcagacgctactttatgctgcccttgacagaaatggtctcactcttccttgatacttcatttaatcctgaatgagacctttaagtcacacatgacaccactccttctctacgaaaatttccttaacctcccagtcagaatgatctctccttcctcggggttcttactgtctgtgtaccaatactgtggtatggatagtattttttcatgtgtatgtatctttctccccacaactgggacataagataccagattaccacgcctacgtggtgtcttgttcatataagataaacaataagcacttgttcggataactagaatttgtgaacacaaatccaggcctatcataagtgattatccaagaattctatagaacttacccaaataatatgaagaaatgaaaggccaaatgacctgtactaactctttctcaaaaatatgcaagccaagcatgtgaaggctgcaacatttccacagactcaaaaacatggctcccaagtccagcctcaatgatatctactggagcccaaactgagttttcatttcaggtgggtgaccacctcaacttacctgtgtaacagactgatgtatgtcaggaaagtctctccattttcatataagatgtacagtgggtatgccactacttcatctttgccgttttgtccaaatagagtctttgggactgctgccaatggcccaaagtcaaatgcaactgctgtctctcctagagatgcggtatacgcccttctggaaagagatgtaaaaaccaacttgttaaaaacaaaaacaacaaaaagtaaaaagaaaaacaaaacaaaacaaaaacacaaaatgtctaataacaggaggtgggtatgtatggaatttgtaggcaatggactgaaaagacaaaaaatgattatgaagaatgttaacatttaaaaattctcagctgggtgcagtggctcatgcctgtaatcccagcaatttgggaggccgaggtgggtggatcacctgaggtcaggagttcgagaccagcctggccaacatggtgaaaccccgtttctactaaaaatacaaaaattagttgggcgtggtggcaggtgcctgtagtcccagctacttgggaggctaaggcaggagaattgcttgaacctgggaggcggaggttgcagtgagccgagattgtgccattgcactccagcctgggcgacaagagcgaaactccgtctcaaaaaaaaaaaaaaaaaaaaaattctcatgaaattaagtgaaaaaagctggccataaaattatttggttctactctcatcttaaatagtttaaatacacagatatacaaatagcaaaaatttattatatacacacacataaatgcaaaaaggaaacaggaaaacacatgaaaacatcaacagttgtctctgagcagcaggatccgtaagttctacaaatactcgcaaagcacctactctgtgccaggtacttttctagggtctgggaatatgtcagtgaattaaacaaatgtcctgccctctagagagagaaataccacaaaaagagaagaaataaagatggaacataaactcagaaaatatcatgaaaaataaagtagggtaagagggtattgatggaggtgctactttagactacttggtataggaaagactctgataagatatttgagcaaagatctgaaggaagtaagagagcaagtctgtggttaactagggaaggagcagttgaggtggagagcaaatgctctaaggtagaagtgcttaatgtctgtggaatggcaaggaggccaaggtgcctggagcccagagagccagggcacagagggaggaatgaagctggaaaggcaatcaggtggcatacctgtggaccctttataggtaaagactctgggaaatcaatggggtatggagagcagggaagtagaatgatctgattaaactgatctgattaaacttagattaaagtagaatgatgtgattaaactttgggtgctgtattgaaacaggctatagctataggagattacaaagattttcattttcttcctaatactttgatctatttttctcaattttctacagcaaatatacattacatgtatatcaagaaggcaaatcataaaaccatgctgtttttatatttaaaatttactgtagttattcaggaagattctagttcaatacaaagttaacaaatatggttaaaatgaaatcacaatttcatatagttgagagagcaaacatcaatgcaagatattatcttagtttctttatcacatagaaaggtgataaagaaatgaatggtggctcaggcctgtaattccagcactttggggaggctgagacgagcaggatcacttgagcctaggagttccagaccagcctggccaacacgacgaatccctgttctactaaaaatacacttacttctcacattaccaaaagcatgctagtcacctctgaaaaaccttgcaacctgttaaaattgcatttataatcccaataagctaattaaaaaaccatttcaagactcaaataaaaacttaccctttattgagtactagactttcctcttcggcttctgaaagtattatcacgttagtgggtgtctgcggctcacgtagtgagtaaattctagcaaccaaaagagaagaaaaccagcacttaaaattctgttttcatttcccaaaactgcactttcctctccatctagtcagttcttgagaattttctaacacttatcacaactatttctttgcaaaaatcttgctgttgcaaagtagtctagttcatttattctttaactacataagggagtttcattggggcctgaagaaatgttctctatccttaccaataccctttaacagcctattccataacatcgcacctctgtcacttccgtcctgagcccttagctatactcgccttgtccagtcatctcactattgcccctaagcttgccagttttccttcaactacacacatctatctctgcctattggacaccaaatcccaccagagaaagaactgtatcttattctttatatgccaactggctgacagagtgagtgatatttagcctgcaaatctacttatgtgtttgttatataaaaacccaatattggccaagcacggtggctcacacctgtaatcctagcactttgggaggccgaggtgagcagatcacttgaggtcaggagttcgtgaccagcctggccaacatgatgaaaccccgtctctactaaaaatacaaaaattatttgggtgtggtggcacacacctgtaatcccagctactcgggaggctgaggcaggagaatcacttgaacctgggaggtggaggttgcggtgagctggaggctggagtgagccaagatcacgccactgcactccagcctgggcgacagagcgagactccatttcaaaaaaaaaaaaaaaaaccaaacaaacaaacccagtatcgtatcatctctattttcaagggaaagtataatactgaatttttttaaccaaaattattttaatttaaagtaacctacatttcacagcatataaggctattgtgaaaaagggaattttcaaaaggccagtaatgtcattttagaaatccagtgtcccttataatcacttattttgtctgacgccactaagaattttttaacttggtttcttccaatatcaataaaatgccacattaagtatttaataaatttttaatgataacttgatccatttgaatacacatttattacagtcttcctaggttcctacaagcgttactaacttcaaaatacacataaatactaggcaataatgttgtactggggaacagtgaaagaaaaagaaggtgcaacagggcattcggtgaaaatttccttttgctctgaaactgcccaaaatctccaaagcttaggaaaacagaagtgttaaataccacatattttaaaaaagaaccttcaatatttggggccagatacttcctttggggcttaagaactgtacctatgctatcttcccaccatctccttttccatcatagcatataaaaggaagactaagaagagaggatgtcaaagattccttaggagtacagtataatgtttgtaatgggaagattttccctctcctctttctctgccctgaactctaaagccaaatgggtgggcagggaaggctctaggaaacagccagatgtggaggtacctgtaataagggagactggtgcatttcctagctgaatgccccttagtcacttagtagctgtctcagttataagatcgaaaaaacatagcaatacacacgtatcacgttcagtactatctacagtttcaggcattcactggggggtcttggaacacacaccctgcagataaagtatactgtaccccatcttgagagaagattcagggcatagagaactgacaggagccaatgggagccagagctcctcagtgatggggggagctggaagttcaacactgccctccaacaccaccccacccccccacatacacacacacaaacacaccatctatgcagagactaccacatcaacagagttcactagtgacagatggaacgagattcaaacaagatcaggcatacttccccatcactcacaggctaccagttcggtaagatctctacctcacctgtcccactcccctaccccacactgaaggagttagatttggaggaaggagggggcagcccattccttacacttcaccctatgttccaaagtgctgggataacaggaagagtgaaagagcagaccgcacactctccaatcacttctgatcccacaaaacacaggtctgacctacaaaagggccaggacatagttgtgaaagatttgagatcaaatagctttcgacattcttattttctttagacagggttttactctgtcacccaggctgcaatcttcctacctcagtctcctgagtagctgggactaccggcacatgccattatgcccagctaattttttttgcagagacaggatctcactgtattgcccacattggtctcgaactcaggggctcaaatgatcctcccacctcggcctcccaaagtgctgggattacaggtgtgagccactgcaaccagccaagatgagttttaaactggacacactgttttcataactagaagtaacgagaaagctatggggatctgtataagacatcattaaggggtgagtcattcagcagtgaaggaagatttagtagagcacagttaaaagcagtgattacgaaaaataaaactgaaggtatctgtacctctgctgagtccccccaataactttttacataaggccgatccagaaagttagctgataatagagtagaaatctacgtagcattagggcatttaatcatagagtgcaaagcttggaaggggcgttagaaactattgaatcaaacctgctcaatttaaaagattggaaactgagccccccaacccctaaaaagctcaagatctcaaagataacagaaaaggaggtgggacaataattcaaatctctaaatttacacttacattctctttcctttatgctacattattaccaaaagggtgacaatgatgaaagagttttggaaagattattctaaggtgtcagattaggagaggagatacctggaggcaggaagactagttgagaaggaatagtggtaagttagagcagttaggcaattcttatgattgagaatgggttacaacagccatccaataaaagcactgactcattcaatgactcacttcgttctatgttgagctgttaattggcaaacagaaacagagctttcccactcgcaaggcttcaagagagagaaataaaatttacctgattacgttgtctgatgttaacagcactacgtggggatccaggatttcacttggataccatgcagcatgctttagagtcagagaggtggaactggtgaaaaatctctccgcaactggagtggtactaaaataaagataataattttccaaaacattttgtacaacttggatgaaaatcttctaaaggaacttcttttttttgcagatggagtttctctcttgttgcccaggctggagtgtaacggcacaatctcggctcactgcaacctccgcctcccaggttcaagtgattctcctgcctcagtctttcaagtagctgggattacaggcacctgccacctcgcccagcgaactttgtattttcagtagagagggggtttctccatgttggtcaggctggtctcaaactcccgacctcaggtgatctgcccacctcggcctcgcaaagtgctgggattacaggcatgagccaccacgccaggccctgaagaaatttctattttaacactctttgattctctttccttcagatttatttccctgaaatcatgctgagaggacattcaaggcatctattcaatcaatatcaaagaattgaaataaaaatatcttctaaattatagcacactggctgggcgcaatggctcacgcctatcttagcactttgggaggccaaggcaggtggatcacctgaggtcaggagtttgagaccagcctggccaacatggtaaaaccccgtctccactaaaaatacaagaattaggcaagtgtggtggcacatgcctgtaacccgttacccgtgaggctgaggcagaagaatcgctggaacccaggaggtggaggctgcagtgagctgagcttgtgccactgcactccagcccgggctgaggaggttgcagtgagctgagatcacgccactgcactccagcttgggctacagagccagactctgtctcaaaataaataaataatttatttattttaataatttaaattatttatttaaattttatttgtttatttatttgagatgaagtctcactctgtggcccaagctggagtgcagtggcgtgatctttgctcactgcaacctccgcctcctggatttaatcaatacttgtgccttaacctcctgagtagctgggactacaggcgtgtgccaccacaccccacttattttttgtattttagtagaaatgaggtttcaccatgttgcccagggtggtctcaagctcctgagctcaggtgatccacctgcctcggcctcccaaagtgctgggattacaggtgtgagccatcgtgcctggctccaaattatagcatatttcatacgtatatatacattttaggatggtttgacttaggattgatacatatttatacagtacaagtgttttcagatatagtatctcatttgatctttttactaaccctgtaaggaaattacaagggcagatattatcaatcctatttttaaaatgaggaaacagatttagaaggtaaacagtttaaggggactcaacttataagttgcggagctaaaagcagtttctaccttatacagatgatccccaactttacaatgggtttaccagtacataagccaacataaactgaggagctccttacgacttatgatggggttacccatcataatgttgaaaaatcctacgttgaaccatcctaaatcggggatcctctgctgtgttgtcagcaataaatccattttcaacttacactgggtttatcgggacataacccaatcgtaagttgaaaagcatctgtactcttttcagtagatctttcagattcacttttctggatttgttgaaaaagaaattatataaaaataggccaggtgcggtggctcacacctataaccccggcactttgggaggctaaggtgggtggatcacttgaggtcaggagttcaagaccagcttggtcaacatggtgaaaccccgtctctactaaaaatacaaaaattagctgggcatggtagcgcttgcctgtaatcccagttactcgggaggctgaggcagaagaatcgcttgaatccaggaggcggagcttgcagtgagccgagattgtgccactgcactccagcctgggtgacagagcaagactccatctcaaaaaaaaaaaaaaaaaaaaaagtatatatatatatacacacatacacacacacacacacacataaaatacttacacttctggcaaacttctggctgacagataactggttttacaaaatcttacttctacctaatcgaaagaatggcctagcctcaaatgagacagcaacgtggtacttcaggcagaataaagtacaatcaattacacatatactatgaacattgataacacagaagccagtctgcagaccacgaggagtgttttaatgttttaagagtagtatactaaacatgcttaagaaccactagtcttgaacaattttctgtatatataataaattatacagataaatagtatacaacttacctacaattcactgttgattttccaccttcaaattcagaattcttcccccatcttttaggtaattctaataccataagtccttttattcctataagtgctacatgatgttgtgttgggcttaacaagacttgatagatttcaaacaggggtggatttatgcaaagcaatctctgaaaattagagcaaaccagtcaacatagttaattttaatttaaatataggtggcagttacttgaaatcacagtaatacttagtttactacaattataggataataaaactctggataagtactcacacttgtaccattaactcacaaatttttttttttttttttgagacagagtcttgctgtcacccaggctggagtgcagtggcagcccactgcagactttactatgggggttcaagtgtcctccccacctcagcttccagaggagctgggactacaggtgtgcaccatcactcccagctaattaaaaaggttttttttgtagagatgggggtttcgtcatgttgcccaggctggtctgaacacctgttcccgtgctcacaagatccacctgcctccaccttggcctcctaaagtgctgattataggctacagctaccacacccagcttactcatgcttgcttttaacatccaaagttacaactcatgataagctgctttcttccccatctctaaggttttgagattttggaggagtgaaggttattgagatagtcaccaatatttactgaaagcttataaattctgggcactccagcatttctgtatgctggacatacaaaaataagtaaatagccaggcgtggtggcacatgcctgtagtcccagctacttccaggcgctgaggtgggaggatcactcgacccctgacagtagaggctccaatgagccgtgatcacaccactgcactccagcctgggcaacagagaaagaccccatttcaaaaataaaaaataaaatacgtttttaaaaaatgacaagggcagacccagcccctgccttggagcttacagtctagaaaagaagacagaggcagagtgccatggctcacggctgaaatgccagcactttgggaggccaagacgggtggatcacctgaggccaggagttccagatcagcctggttaacatggtgaaaccccgtctccactaaaaatacaaaaagtagccgggtacggtggagtgggcctgtaatcccaactactcaagaggctgaggcaggagaatcgcttgaatccatgaggtggaggttgcagttagctgagattgcaccactgcactccagcctgggcaacagagcgagatcctgcctcaaaacaaaacaaaacaaaaacagccgggcgcagtggctcacgcctgtaatcccaacactttgggaggccaaagccagcagatcacgaggtcaggagttcaagaccagcctggccaacatggcgaaaccccgtctctactaaaaacacaaaaattagtcgggcgtggtggcagatacctgtaatcccagctactcgcggggggggctgaggcagaagaatcgcttgaaactggaaggtggaggttgcggtgagccgagatggcgccattgcactccagcctgggcaacaagagcgaaactccatctcaaaaaaaaaaaaaagacacaaaataattataaataattaagttatgattatgtcaaatgctacacagcagtatagaatgttattagaatactgcgtgctgcacatttggtaattattattattttttgagacacagtcttgctctgttgcccaggctgtagtgcaggggcgtgatctcagctcactgcaacctcctcctcccaggttcaagcgattctcctgcctcaggcacctgagtagctgggattacaagggcgcgccactacacctggctaatttttgtatttttagtagagacggggtttcaccatgttggccaggctggtctcgaattcctgacttcaggtgatccacctgcctctgcctcccagtgttgggactgcaggcgtgagccaccgcgcccggccttcataattctttttaactgaaattgggtaaataagtagactgtagactcctgccctattttcaaaactgcagaagcattgctagcgtcttattaaaattaaatcacttctcggtaacaagaattggaccgggcacacaacagatgtcataccttagaatgagtaccaagctctttttcatctttaagagaatctgtgtattacaaataaacatttccataaaccaatatttgaccacggcaagtgtgtaatactttctggatcacacccattttcacatgctgtcggctaatcaaaaacaaaaatccccattttgggtatggctttattttctaaagcgggcgttacgggggtaagaattaacagagacttcctcctccatgtcaagcatgaagcgtggtgctttgaaacctgcaacctgacttgctgtgcacaacgcaagagaaagttacgatctaacctattataagcgtcacatcaggaaacaggtttctctcgacgaaactaaaaatagcaactccgcccactcgttctcaacccctttagcccgctttgtttttctccagagcactcatccgtcactagtatttttattgaatattcaatgaccctttccttcctcccaggcctccaggccgtaagcatcgagagagcctgagtccccgcgaccgcgtatggcagcgtcggagtcaatccgctggaacgcctgccacaagatgaaaaacagccaagaggagcaaggaacaaaaaagactggttccgatcccggtgagggtcacttccaagatcggcctggcattacctggtactgggacagggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacataatggtggtgctgctggaaatctagcacctggggagagcctgagacttgtgtatctaattgcctattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcaggtgggtatggggtttgtgcagtggtctaccctagatcgtcccggtgaccgccgtcttccctgccttcgccttagccctgctccgtggagcaggtgccgcagcgcgcctggtctggtcaaacccaggcctgctgactgtagagtgtgggattagcccgggtcggtcaagtcctagaaagccttgtttttggattcgattttgttttgaatttaaattgtggtcaggacatcaccgtttgcacctctgcaataacactacctactgttgctgcggaggtggccaccgagagaggcactttgtctacgttcgtcttgtgagatagagatgatttctattctagagagtagtaaaatgaggcttagaagagggctccacctcagttctggcctcttctgaacacagtgtggttattagtaagtaatgtccaagaaagtaacccgacgcaagaaagatagcagatacagcagagtttctcagccttgacaatggacattttgagggagatatttatatgttgtggagggttgtttaagccacgtctcgggcctccacccactagatgctaatagtcctataactagaattgtgacaaccagaaatgtctccaagcattgccaaatgttccttgggggacaaaacctccctgagttcagaaacgctgctgtgcaggaaggccgttacccagccatatctagagtagcaagaatttggaaggaatataaatgttctgtaataggacattggatgctgagatattatgcacacaaccattaaggaaactggcaagctagaataaaaaatatggttctttgtaaatacgtgtacaaagcattgtaattttatgtatctctacagaggaatatgcaaaagtaacactagttagtattatcattgaaattttgtgtctataaactttctttaatgttttctcaactaatgtaagagtgttttttaaaaatagaaatgctttttttttcccccccaatcttgctcttttttcccagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcaggtcaggctgggctatgtgttttcagggagggggactgcaccaccaagaacggctcgtgtcctcttttatttgtttacttgagtcctctaaacccaccattcccctaaccccatttagaattcaacagcctttaacccaggcttttctacacttaatgttagacttgtctagatgaaatggtctgaaataccagaccgtagacctgctcatcactgcaacatcatcatttatgaaactaaaaagaaagaaatttcatttcttgcctccacccttggaaattatgattcagtaggcataggctaggaatctctttctctccctctctctcgctctttttttttttctgtcttgctctgtcgcccaggctggagtgcagtggcaagatctcggctcactgcaacctccacctcctgggttcaaacgattctcctgtctcagcctcccaagtagctgggattacagatgtgtgccaccatgcccggctaattttgtttctgttttagcagggatggggtttcaccatgttggccaggctggtcttgaacgcctgacctctagtgatctgcccacgtcaggaatctctttctaaaaaggtctccagaaactttccgattctaatctcagccaacgttggcagccatgtgtggaagggaaaaccatttatagtgtatcaggaagaacactggattcgaagtcaggagttccagaattcaaatcctggtttggctattgactgttaacttcagtttgcctctttgaggtttagttttcacatttataaaatgagaagataatgttttcagcattgtaaggactgtgtaagaaaatgtgggcaactgtttgaaaccatcaacaccctgtgtaataatgatgcattattcagtggcttttgtgtgtcctgcagtacaccaatgtttgccttatatcaccacaactagtactcacagtaaccctcttagatagattttattcccactttacagaggccaaaactgagatttgcagagattaggaacttttcatgtggttacgtagccttggaagaatatgtacctaactgctaccctatatcgtctctccaaaattgggtaccattattttgtcactggatagttggatcatttgttgatggcttgtcagcatgacagcattaccccactgtcagcatattctgcaggaggactggactgattttgtccaataaatctgggttcttcaagccagcctccaagtatgaatcactgtggggcttggttggtgattaatacttcaaacttctgatgccgctcctttctcttccagctggaggagctgatagacatggctgtgctggaggaaattcaacaggagctgatcaaccaaggtaacccctagtggtagtccttccttacctgtatttagctactggaatactgtgacctttcctccaatcaggattagtttataagtcccctttgtctacctccatcagtcaagtgtccaaaagactccttttgtactctgacatcttggctgtctagcttctcaataataagggtctccagggtgctagaccttgtgctaagaacttctcatttaatgatgctgttttctccatgtgactgccctgtaagatagtagtattagaacagaaggtggttggtgttctcgtgcaggtcatacagctagtaagtggaggagatgggaagcaaaatcagttgtatgaatccagttcccatgtttcttctaccatcctgcctctctattaatgggttaatagttcactgagggtggtggcttatgcctgtaatcccagcattttgagaggctgaggcaggagtattgcttgaggccagttcaagaccagcatgggcaacataacaagatcctgtctctacagaagtaaaaaaaaaaaaaaaaaaattatctgggtgtggtagcaaatacttgtagcctccctcagccagaaggcttaggcaggaggatcacttgaacccaagagtttaaggttacagtgagctataattttaccacctcactccagcctggctgacagagggagaccctgtcactttaaaaaataaaataaaaaaaagtaaacctgccattttacaggatacagtgatagtgcatggtctgatcccttgccctattcattttaagtgccacattctctattaactccccagggcctgtgagcatccactccttgagggaggtgtccatagcatggtgtagagagcataattttgtaccttatatagttaagtcatttattccatgtagccctgatttgattaggccttgtttggtttttgtttttgttttttttgagacagggtctctgcccaggctggaatgcagtggcgtgatcacggcccactgcagccttgacctcctgggcttaagcgatcttcccacctcagccttctgaatagctgggatcataggcgtgtgccaccacccctggctaatttttttttattaattttttttttttagctaaagatgataaaaacaagacaaaaaattattttatttatgtattttttttttttttgagataggttcttgctctgttgcccaggctggagtgcagtgatgtaatcatggctcactgtggcttcatcctcctaggctcaaccaatcctctcatctcagcctcccgagtagctgggaccgcaagtgtgcaccaccataccgagctaatttttttatttttttgtagagacagggtctcactgtgttgcccaggctggtctcgaactcctccctggtctcaagtgatccccccacctcagcctcctaaagttttgagattacaggcatgagccaaaatgcctagcctaattttttaaatttttttgtagaggcagggtctcactatgttgcctaggctggtctcaaacagctggactcaaaccatcctcctacttcagcctcccaaagtgttgggattacagacatgaggcatggcccccagccttaggcttcatttttatgacctataaaatggagagaataccctataaatttgttgtaaggcttaaataacgtgtgtagaagacttagtgcattgtctggcatatagagagctttcaataatcaacagctattattatggtgaggcaagagcacaagctcttgagtcatacctctaacattcacttggctttactactttaatttgtgtggcaccgaccaaagcacttaatttccccgtgcctcagtttcttcacctttgaaataaggataataatagtgaagaagttaatatatgtaaggaatttaaaatagcatttgacacataagtgccatgcaagtgttagttgttaatgactgttgctgtcgactctggttagactgtaaattccttaagttatcatctttttttattgattttcccttcccccacctacaaaacctatcttagtggtgaaacataagcctgaccaaatgttttattttggggcatacttaactaataagtctgaagtgacaaggatttactgtgttgtgctgtactcagccataaggaacattctaaagcagaagttggcagactttttgtgaagagccagatagcaaatactttagacttcacagaccatgtggtctctggcacaatttctcagctctgcagttctagtggaaaagcagttatagacactacataaacaaataagcgtgactgtagttttttgaccccttccctaatgtctagactgtgagctcaacaatgacagtctttttcatctttgtgcccctgtgactagcagatactaggtactgttgtatgtttgctgaatgaatgagcacacagattctgaacaacacagattccaagtatgtggaatcagcagggtcgtcctggcatcagaaatcagttctctcttttttttttttttgacacagagtctcgctctgtcactcaggctggagtgcagtggcgcaatctcggatcactgcaacctccgcctcctgggttcaagtgattcttctgcctcagcctcccgagtagctgggattatagacgtgcgccacatgcctggctaattttttgtgtttgttagtagagatgggtttcaccatgttggccaggctggtttcgaactcctgacctcgagtgatctgcctgcctcagcctcccaaagtgttgggattacaggtgtgagtcaccgtgcccggccagcaatcagttctctttgtcaactttatttagttgcctgtgggaccctgacattctgtatctgtgctcctatggcctctggagatgtgtgtgaaaattgtctcctcggcccttagcctacttcacctcttgtgctcacaaaaaggggacagagaggagggagaggaatccagcaagatgaagccagcctgagagagcataaaaaccagtcattggtattgtggtcttgcccaaatctttccctcgtgtgaaggaagcctttgacagtgaagtttagaattaaatacagggccagctgaagcatggtgaagccctccaactgcctttgccttgcagagcagtccatcatcagcgagtatgagaagagcttgcagtttgatgaaaagtgtctcagcatcatgctggctgagtgggaggcaaacccactcatctgtcctgtatgtacaaagtaagagtttttaaaaccttttcagcattattcgttcccattccccactccaaggtgagtggaatctccccccagatttgttgcctgaaattcaaggtttggagatccaggtctggtggccatgatgctctgggatcctaattctgcttctaggtacaacctgagaatcacaagcggtgtggtggtgtgtcagtgtggcctgtccatcccatctcatgtgagtgttccacacacagatttcatgatacttcttcccacatggatctactttcttgaagatcctccagtgctgacttggagcccattgtgcatatttcttcccagttttatgttcagtggtgtcacattggtagcttcaaatcagccatggtgagaatatctatggcatgaaaattggcaaacagtacacatcagagcctttagggccctggagagccatcaccgcttaacgtttttatggagacctcagcttgggattggtaacgcctgtatctgacgtttcataaaaattttctatatatgaagacatacctaattcagaatttaagcttcagtaatttttttttttttttttttgagacggagtctcactctgttgcccaggctggagtacagtggcgtgatttaggctcactgcaacctctgccttgcgggttcaagtcattctcctgcctcagcctcccaagtagctgggattacaggtgcctgccaccacgcccggctaattttttttttatttttagtagagatgggttttcaccatcttggccaggctggtctcgaactcctgacttcgtgatccacccacttcagccttccaaagtgctgggattacaggtgtgagccaccacgcccggccttcagtaatcttaaaatacagaaaaagcccttttatctggcatgatggggactgcaagtttgccagttaattgagcgattggttaaagaggcaaattataaaaataaaatgttttatggtaagtttcaaacacataaatttatttgccagcctttgagtggggccctgctgattggagagctgagtcacctgttttattttttattttatttgagacagagtctcactctgtcacccaggctggagtgcagtggtgtgatctctgctcactgcaacctccacctcccgagttcaagcgaatctcctgcctcagcctcttgagtagctgggattacaggcacgtgccaccatgcctggctaatttttgtatttttagtagagacggggtttcaccatgttggtcacgctggtctcgaactcctgacttcaggtgatctgcccaccttggcctcccaaagtgttgggattacaagcgtgagccactgtgcctcgctgagtcaccttttttacataaacaacttctataatacatagtccagagtttccggttttaattccataaagtggatcaagaaactgagtatacaacttaggaatttttcctccccatcttttacctaattctatagctctttttctttctttcttttttttttaagcagctcatctgtttgtttcctaaacattctacttatcactataaaaataaaacttattatttacataataagtaattagcattactgagttacagtaggaagttcaagtaacccaagcagacccgggagcatatactgctagttgttggtaaggatgcactcagctggtgggggcagaggcagagggaggctggaaagtagcctacaatctctgagcgttcttcctgccatgagtggccatcagtgtgtttgacagcaggagtagagggcgttggttaatctggagaggcagttaaatggagatgggttaagagatcttggtacagtcatgggcccgagtgtctttaaggctccaaggagtcaagccatcacagtgagccacggttatattggttggcatgaggaatgaggattttccatctgttggctatcaagtcactgagaggaggttgaacttttttattttgtagtcttctgagttgacagagcagaagcttcgtgcctgtttagagggtagtataaatgagcacagtgcacattgtccccacacacctgaattttcagtcactggaggaacagaagaaaagtccagtcttctcatgagctgtctggtaagcgtctcctgggacccactctgtggtaagagggacctgtggttggttttattcccaccttgatagaaataatgacctataaacaggtaaatgtttaatgcagtttattatctgaggaatttacctgcatagaaaagtgaaggtaacaagtcatttagactcaaaggccagtcagaaagaagggaagaggcagcatgggatcacggcaagaggattggtctgggagttaggacgcctggctccacacctgctcttctttgatcagtagtagtggttttggattcagctggtcatttcatagtcataagacccagataggccatgctggcaccacttttgcggaaggaaacagggcagaagcatagcagggcagcattaggtttgtctgtcagtggagtttttacagaggtccaagggctattcgctaacctgagtgacaactgaggtgtgagggccaggaacacaagtgggtaagggaaccacctgtcttagaagcgtgctataggaaccaatatctcttataatccatgtcctttccatatatgtgtatgtatgtatgtacatgtgtatatatatcacacaaacacacataaaaccaatatgatacgtattattattgcttttagatcccaggcagggggagccttgggattaggagcacactgtacttcaggaagttcatagccatggctttctactgggaatttagaattccttcatggccctgtcattccaaatgcagttaacctacagaggtcatttttattataagcagcattgcctggtaacagccatttcacctttatcaagtttcttccataggtattctactcattcattaaaaaaaaaatgaattgaggactcattaacattgagaaatacacatctctcacagagctcaagccttgggttggtaataagagaacagaataaacaggcagtaccctggagagctgtacaaggagggcttatgggagttcagaggagggtgatctcctttatggtgacaccttcctggaggaggcatttaacttggccttgaagcatggaatcgatctggacagacatggagatctggtgagttgtgggggtagagcttaagtggaagatccccacatagaagaacaaggcagagaagcaggaaactggagtatatacaaagagcatcttgttctacttagctggagcattaggttcatgagggagaggatagttcctgttaggaataggaaacagattcagagaagtgatgtaatctggccaaaattttactactaataagcgatagagctggtgttagaccccaggtctttgtggttccagtgcccctgctgtttcctgctccaggctcaggccttggtggaaggatgccattttccatcagcttgtatggaaagagacatagcaggtgaaagtttaaataaaacccctcactacttcctgttgactacaagcatatgttcccttctgttccagctatccagcactggtagcagatgctcaaatatgcagtgctttcaggcctctgtgctgttgtttaggctgttctgtctgaatgactttgactcctcccactacatttaaggatcatttgcacaaatatttaccaagcactacaatatgccgtgtacttcattcagcctgattcctcacaaggaattggccagtctcagctggccacggtggctcacgcctgtaatcccagcactttgggaggccgaggtgggcagatcacctgaggtcaggagtttaagaccagcctggccaacatggtgaaaccccatctttactaaaaatacaaaacttagctggacatggtggtgggtgcctgtaatctcagctactcgggaggctggggcaggagaatcgcttgaacccgggaggcggaggttgcagtgagctgagatcgtgctgctggattccagcctgggcaacagggtgagattctgtctcaaaaacagaattggtggctgagtgcggtggctcacgcctgtaatccccacactttgggaggctgaggcggtcggatcatctgaggtcaggagttcaagaccagcctggccaatatgatgaaaccctgtctctactaaaaatacaaaaaaattagtcaggcatggtggcacacacctgtaatcccagctactcgcgaggctgaggcaggagaatcacttgaacccaggaagcggaggttgcggtgagcagagattacgccactgctctccagcctgggcaacaagagtgaaactccatctcaaaaaaagcaaaacaaacaaaaaaagaattggccagcctgggaagtccattcctttggagtctgtgttaccattctcaataaacctaatgagggctggcagaggggaactggccagtctctccttgggctttcaccgtacctcatgccatgtcacctgtaacagtgttgtagttacctgcttatgtctttgtccttgagggcaaggcccatatttatttttatttccagtgcttggcatatattaataaagaggtgcttaagatgtttgtacaaatgagttaaggtggagggaggagagttgaggcacaggtcagctggctttggcttctgtcttcttagtaaggtgaacagtgagtcatccacacagattataatggtagcagagctggagtctacagctccttgagtatgaaagtccccttgagtgtgaaagacaaaatgctggtcgggggaagagaaggggaattaaaaggtaagtggaagatggcctaattgccaagtgtacagcttcagctcagcatataattgttatggaccccagttatccactcacctaaccgtcagtgccctgtggctcagagcagcagtgaagctaagtaggaggtgaggtttggaaggtgagtgctgtgcagcagtcttggagatcatagttgacagtgccggctctggggtgggcaggaagaccattgttgggtaagtgaggggaggtgggggtcacagcaaatatgagaaacacagccaggcactgtggttcacacctgtaaccccagcatttaggaaggctgaggtgggaggatcacttgaggccaggaattcaagaccagcctgggcaacatggtgaaaccctgtctctactaaaaatacagaaattagctgggtgtggtggctcgcacctgtactcccagctactcggaaggctgaagtgggaggatggcttgagctcaggaggcagaggttgcagtgagctgagagggcgccattgcgctccaggctgggtgacagcgagattgtgccttaaaaaaaaaaaaaaaagaggagggggaaagacaaaattgtattctgtaggtcttgagttcaacatttggaaaggtagacatttggaatgctctagttccactagacctttggttttcacttaagggggaatcaaggaccattgtgttagaatccagtgaggtcaggacgtagggacgctcaggacagatggctgaggatgtgttgaaagataggggtgggttacagaagattgcactctatcacaagacgaggaatgtttcggatgtggcggtgctcaagtggtggtcctgggatggaatatgccaaaccgcctattagcagagttacagtgtcttttagagaaagccaaacatattacctgtggaagtggtaagaaacaagagtaacccacttatgcctactgtttaattattggaacgctaagcctgtgggagttattgatcccctactgctcaaggtcatcgccaaggtctgatttttcacacaaaaaaatttgcaacctctggcataaatgggttaaggacagactggattccttagcatagtggagaggctgagccacccaggagtcgggaggcagttttacactcaggtgcttactgatcatgtctttacatgttttctgcccgtactgatcatgcatggtttgcacctcccctatgatacatacctgcttcaatcttgtgtagatttggagtctcatcttcctgctgggctctaaaagctccaggctatcaagagtttgaatacaatctttctggtcagtggtttcctgatggtgaggatgtttgattagttcatctacaggatttgatcttagcttgaagactattgatgctgatggttcccagggcagttgtttgaaggctgcaggacagaggtccagcaatgccaaagaggggcggtcatcatgacaaactacactactgaactaattgaaactggactcaggagacctcatctaatgtgtagaattctcattgattacaacttttatcagatatctttcatgactagaatacaatttaagctaattattttcctgtttaaacctaggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacatataatttaaatttggtattttttcccccatgatattaggatgataatcatttcaaagcacatgtctagcttcagagtaggatttgttcactggccaaagcctgccatgaaactatggctttcagcatctgtctgctctactggctcttgacaaaactcttgaggtcttcaagaaaagtaatgtactcctggtgctccagggctgtgctgagctccaccagctcatctgcaaaagtgttgtccacccctcggtcggcaaggaaatccattaggtggtcatataaggcctgcaaagaacaatatttactagttaaaaaaaaatctgtaatgaacattaaaatgcttttttctccccttgaactaggacccttccttccaaggcccaaaaggttcccccaccttatcaagcactcacccagtccaaggaatctgtgttgagtgtataattagtatccttccattcagactcgccagtggactgaaagctaacttccctgatagagaagatgtcactctcagcctcgtcttcttgtccaacctgagaagaaacaatattgggaaactgaagggttctccaggacaagctagactcaggggaagaaagggggccactgacagcatgaaactcatcaggttttaaccctcttccctcactccccacctctctccccctgctgggctggtctaagctagaaaagtgtttaaatttctgctaaaatagggacaggaagttcccaagggacacactgttccccaggggtgccaagaggctagcactccatcctgcatacctcatcctctggataatgacagtccaacacaagggccttcttgccatcatcattctttataacttcaaccacgaaattgggagttgatgtcagttcaggctggggaaacaagaagtcaatacatgctgctgctggaaggagatggatggctggatcaaggatctctgttcagagtgtctgatggccaccactattaggatattatgtagccatttgaatagtcttatgccatactattcccaaatgaagagcttgatctcacttctgttggcaccctgcttggttaaataacacactgggttttcagttaagaaatgtggataccagcctcagctatgtgccaattaactgagtttatatcagtcccttaacattccaagccttttcctccacccgtacactgcaaagctttcctaaagtttcaagatctctttccagcttgactgttccaggagtcttcataagggaccagggtcaaaggctggggaacctggccatccttatggctgaataacagcagcagcttttcctctgatgcggagctctgggagcagactgggtccaacgtcagggagatgctagttggggtggctgggaaagcagcacaccagagagctgcgccgtccacaccaggtcatgacccaacactgtactgatggctcttgggcagaatgtctagggactctgtggccctcatactggctggttactaggctgggcacagcacttcctgaaatgtttgaagagtaggcatgatccagttaaagtctcttatgcccctgccattctctctctcttttttttttttttttttttttgagacagagtcttgctctgtcgccaggctggagtgcagtggtgtgatcttggctcaccgcaacctctgcctcccgggttcaagcgattctcctgcctcagcctcccgagtagctgggattacagggacctgccaccatgcccagctaatttttgtatttttagtagagacggggtttcaccatgttggccaggatggtctcgatctcttgacctcgtgatctgcccgtctcggcctcccaaagtgctgggattataggcgtgagccatgcgactggacttagaggaattttttttttttgaaagaccaaagaaaaacgctcctcctctaagccccaggcacagcctgtcagaactgaggtaaaagctgattatagtattagcttacctcctgttcttcaaccttctgcccttgcgagggttcctcctcaccatcaaatgttggtgggatgctgttgttaatgttgaaagtgaccgtgattctaaaacggcaagggaaaacagacaaggcaaaacagacaaggcatggttttaaccgagcaggttaacacataaacatggaaatctgctacagttaaaaaggcgtattgaaacaatgtctctgtcctagctggctgaattatatgcagaacttcaaactaggctgggtgcctacatccaatcctgagtgactcagcaggtctgaagtgtgcctaccatgtaccagctgctggaagccaaagctggcctcagtttatctcagccaaacaagtcatgcatgggttactcccaacagggccagtaccccagggctcactgccatgtgctgactgggcatctcatggccacagccagctgacactgcccaccctggtctttccagggaacccttggtcaaagtaaggacctgagaggctggtgagatggaacagaagcccctttaagagactttccccgtcagaaaatttgccctgcaaggaaaggaagaagcgatggagggtgcctctgctaaacaccgagagcagccctggaacggggaagggaatgcctcacaaagaacaagggctgtagtagagactcatcccttagagtacttgtgggaagtttcataatcacaaagcaggccagacacaccaactagtgacaattttaaggtgcaagaatccacacctgacaaatcatgttccaaagtttgagtcaaaattcttgggacataaggtttagaaccaaaactgctgggctatgcaactctggcaggcaccattccacacaagagtacatgaaggctgggcgcagtggctcacgcctgtaatcccagcactttgggaggccgaggtgggcagatcacgaggtcaagagatcgagaccatcctggccaacacgatgaaactccatctctactaaaaaatacaaaaaaaaaaaaaaaaaaaaaattagctgggcgtggtggtacgcgcctgtaatcccagctactcaggaggctgaggcaggagaattgcttgaacctgggaggtggaggttgcagtgagccgagatcacgccactgctctccagcctggagacacagcaagactctgtcagaaaaaaaaaaaaaaaaaaaagagtacatgaagtgccgccctccacttgtgctaactagctgctctgccaggaagccacctttccatggcaacagaggcagtctgaggttgacaaaatctgtctaattccaactgtgctgactaagctgagctcctgggcacagaaattgaatgacgttcatcagagcattatttttaatggcccccaaatagctatgaaaaccttgcgcaaatggtgtttaggtgagattacagaagacacaattgacctgtgtagggcaaaaacacactatgcaacaggcaagagaatcaggaccctacttcacaccatattcaaaatgaatcacagacctaaactaagagctaaaactagaaaactttgaaaaaattaaggcatacatcttcacaaccttgggttaggcagtggtttcttagacgtgacactaaaaaagcacaagttgcacttggtgaattagaagcaaagtaaaaaataaataaaaaagcacaagcgaccaaaaaaataggtaaactgaacttcctcaaaattaaaaacttttgtgtcagaggacattaccaagaaagtgaaaaggaaacccacaagatgggaaacagtacttacaaatcattaatttgataagatagttgtacccagaaaaacttaacttttacaacccaacaattaaaaaggtaaatagggtgggcagggtggctcacacctgaaatcccagcactttgggaggccaaggcgggcggatcacgaggtcaggactttgagaccagcctggccaacacggtgaaaccctgtctctactaaaaatacaaaaattaaccggacgcacgcctgtaatcccagctaaggaggctgaggcaggagaattgtcagaacctgggaggcagaggttgcagtgagccaagatcgcaccactgcactccatcctgggtgacagagcaagactccgtggggttggggggggaagctacaaattgtatgactccatttatatgaaatgtccaaaagaggcaatcccatagagaaagtagcttagtgattacctggggtggctacagggaggaataatgagtgactgctaataggtattgtttggggatgacaacagtgttctagaattaggtagtgataactgatgcataattctgcgaggactaagaaccacttaatttaataaacttcaataaatgggtaaatcgtatgccatctcaattaaatctcataaaagctgtgatttaaaaaaattacatacacatcataaggtcaattatgaaggaaattcaatttatttatttattattgagatggcgtcttgctctgttgcccaggctggagcgcggtggcgcgatctcgactcactgcaacctccacctcccaggttcaagcgattcccctgcctcagcctcccgagtagctgggactacaggcacgtgccaccatacccggttaatttttactagagccagggttttagtgttagccaggattttctcctgacctcatgatctgcccgtcccaaagtgctgggattatgggtgtgagccaccgcgcccaggctcaatttaaaaacctggaagatgccaaatgtttatctgtgtaatgagattatggatgactataatgcagaaaagtgtaaacactttaacagtttaggagatgatgggggagctgacttaggtcacaaactccccacctctgatggcagcccttactacagtgtaaccccatcctgttacatagaagttacatatttttcattttcacccatactaaacattagagagcagtgtcctattttatcagggctgtaaatcagagatcaaactgattctgccagtacttttttgcactacatttttgtctccttagtaaccagcccacagcaaatttgtgttcggtgaatggactgcctggggcttacgaagttgtccaaatgaatccttcactctcttgaaacccatttatcaaagtatccacacctgaactcaaggctcttctggggatgacccaggatgggtcctgcaaggttaagggagttgctgccctgggatccccagaccagtacttacttttccccggcaactttccgcactaatttcgcttctgtcccattcagttccagctcccaacctccagacatcttagggagggttttatgcttctgaatttttctttcctccttaatttcatcactcaggaaatcaacaaaagctttgtctcctagaaaagaaatccagatacataaaaaggaaagccagttagtctaaaacataaaactattacccaggttattgcagccagaaacctggactgtttctaatctctctgctattacggttactctagaagcctgtttccttatcggtaaaaataccataatagtagtaggaagctgagcctgattctggaaaagtgatttccaacaatgaacgcattaccactttccgctataaaccaggagaatttccaatcctcttccacttgccaaacgatataactatgctattttcaaccacgaccatgggccttcccaaaggtccactttcgatagaataagactaaggaaaaaggtaccctagtatttaattttattcaccccctaccaaaagaaaacgaaactgctggataggggaggtgggggaaatatgatcatacgtgggtttagcccgctggttgccaatcaatggaaaaatgtcccagacctcagaggtcggttgcaggccctattcctggtctacgttttccctctgttgaacgcaaaccacacccccggcccgctaaacctcaccgtcggtgtgcagcgagccgcagccacagccacaggcgcagggtccgcgaggccgcaggaggcccggccgccgctcggaacctgcgcgcacgctgagcagcccgaagggccgggtgcacagccggggtgccggctgcaggagctgccggaaaggcgaggcgggcgcggcagcgcggaggccggcgacggaggagcccagcacacggggcacgcagcgcagcagaggcagcatcgcggaaacgactgcgaacacgtgcagatgcaaaggacaacccaggcctaggcgccccgcgacctgaggcgccgccggaagccccgccc

SEQ ID NO: 15187 - DNA, 1611 bp, Homo sapiens
gagcttcttccccattccccaccctgctcatctccttatctgtatccttggtcatatcttttgtatgaaaccggtaaatgtgtttccctgagttctgtgagtttctccagtaaattaatataacccaaagacagggttcagatttattaaaaatcaacaatcctaccttcccaggatatacaggacatataagctactaagaaggtatgtcttactaactcatggtaagactaacacttaatattttctaaataattttctatgaataatggaaaagagatgcaagaaacaagccacacacatcatatacaagattcatttttaatggatttgatcgtcgggtgcaaatttgagcattatttacaagagctttctgtagagttatttctgttcaaataaaaccagactctcaaaatacaacataagcctgaacctacttgatttttttttctccctctagttaccaaggaatatcgtatctcagatgcatggcctactatcacactggtctttaaagaaaaaaaaaaatgcatggccacagttccaggcagttcctggtagctggatttagtggatttatatatgacagtacagtacatcatcagtttcacccacagggcagaacttgcctccattcaggcatctctttacaactggcagcaatgcagcattaagggtttttagccaggacctgctgtttgcagtcctgccccttgtagtgttactctgggtgttgcacactccatgattactagaagacaaacacctgaggcatgcaatctgcttggagtgcatctatttacatgaagctgctcacgggagctggtgattcttccagatatgggtttcgtaggttggcaaagagttatcacaccatcagagattttaccaatggaaagagagtagctgaagattatattgcaatgttattgtgaaacatttaactttcttaagtttaaagtgtactatctcctgcagctcaatataaacaacgatgtatttctttgtagcagtatgtggagtcagaatgggttttccaatctgatttaatccctgagcagctatgttaaaagttaactttttaaaaaagcccaataaaaaactaaatactgtattaaaactctaccacaatgttacagggataaacttatttctgtacagaaacattaaagctacttagaagctgtttacatcctttgcctctcagaaaaaaaatatacatttccggaaactgttcaggtacttaagctggacataaattaccccaagttttttctttttctttctttctttctttttttttctgagaccgtctcacactgtcggccaggctggaatgcagtggcgtgatcttggctcactacaaactctgcctcccaagttcaagcaattcttgtgcctcagcctccccggtagctgggattacaggcgtgtgccaccatgcccagctaagttttctatttttagtagagacggggttttgccatgttggccaggctggtcttgaacttctcaagcaatccacccacctcagcctcccatcccaatgctgggattacaggcatgaggtgatccgcccgccttggcctcccaaagtgctgggattacagg

SEQ ID NO: 15188 - DNA, 695 bp, Homo sapiens
tcagaatggtgttgtcagggatcacaagctcccagccccgtgattagcaaattgaccctgctgccctgtctgctggctgctttcttattctgagaattgtgttgacaagaccctcttttcctacagagctctctcttaatgttgcttggaatagccttgtgtcctggagacagttttaggtctggcaggatctgagaacgggagtggggatcttggaatgggatctgcatccctgagcttcatccacaaagggtgggaatgtggcttgggctgtggggtggaggtagatgaacagctggacttgcaggtctatcttctgttgtttctcaataaagtagacaagtccatctgatgggtgtttagtagggtatgacttgtgagtccacaaggccagcagtatatatgctgaatggactgcttagcagtaacacactggaaaaatccaaaaagaatggatttcaagttggcaaaaaatgcattagaagtcagcagtgtgatgtggtcaggagaacaaccagagtgactgtgggatgaggtcttggatagctttgtttctatatacagtcagccctctgtatccatggtttctgcatccatggattcaaccaaccaaggctcgaaaatattaaaaaaaaaaaaaatccaaccataaaaaaatacaaataaaaaaaccaatataatataacaactgttca

SEQ ID NO: 15189 - DNA, 510 bp, Homo sapiens
cataaccccgtagaacatcaaatcattttcctttaattcccagagacttaatgtttctttgtcttgcgaatgacctcactgctttttgtatttgtaatggaatgcacagtcatttgtaagtaatcacacaataatcccttacacttttataatgccttacccttttccatagggctttcactctcattatctcatatgatccttataactgctctgagatataagcagagcgcctattttaatctccaattttcaggtgtagaaactgaggttcagaataaagttagccagagttaaaacagttagtatgtagcagaattggaaagggagtctacagaattggaactggagtctcctaaaccagtgtttcttttgctccttattgctggtgtgaccttgggaatatacttaacctctctgaacctcagtcttcctatcactaaattgggtataatactacctcctgggatagttgttggaagggattcaatgagactgggaaatcattta

SEQ ID NO: 15190 - DNA, 4073 bp, Homo sapiens
cagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagcctgcccacatgccaccgagcaaacgcatcttgcttttcacatctctcctcctacagccttaatggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgca

SEQ ID NO: 15191 - DNA, 1227 bp, Homo sapiens
tctcactttccttatctggcagccctcccagcagctttctgaaatctgtgaggtttcagaagaagcttttgagttgaataacgagttccacgttccaggccaagtcatgctttcagtctcctgtttaaaagtctatcaagttttggggcataagggtgggaggaaaataaaaccaaggcccctttgtcagcatacagcttcagtagataccccaaattcttgaaatctgtatagcagactgctggttttttctccttgtcagagcccagcccactgacactttacagttgacagcccagcccagatatgggccgctgtggcttctatcgaatcatgcttgggattgccacagttttcttctttggattggggcttgaggtggttgggaagaatgcatgccaaccagccctgcatctgggacttggagcctgtcagctccctgctctttgatgatggaatagtctgtggacttcttcccatttgtgagagaaaactcccccttagaactcaactggtagagcttctcatagcttacagttccaagcaatagcttggttgtaggtccaggcaggactctgacatggccctctggaatagcattgatgtgttgggttctttgctaagatgatttccagtctgtgttccagggagattcaggaaagctgaagttcattcttagaacctaggtctgtgtttgttgttttgttttgtttaaaaaaaaaaaaaaaaaccttgcctgatcttaagtgccagctgggaacttgttcagcatccacatgccagggcctcttgtcaccctcatttagttagaatttccaggggagggaccaggaaatctgtatgctccaacaggtgctccaaacaggcaggcttgggaaatgctacactaggtagccacccattttccttgttcagaaaaaccttaatctcttcctgtccatgtgtggtatatggctgccatgtagccagcaaccacatcaggctgtagaagacacttgctattcctttgttttacctcggttgcatccagtgctccgggcctttgcttcccagtacagctgatcaaccacacggcttccaaggacttgcccccttgtttccatgataacagccaatcgcataaatccatgtggggtgcaaaacatggttatgggtttcagtgatatatctctcaagaatgcttatcttttaacccaggaatgcaaataaaaatttgtatgaatttta

SEQ ID NO: 15192 - DNA, 635 bp, Homo sapiens
ttagctcattgttttaatgaaccacccaagacctttgtaattaaagaatgtactgaaacccttgaaaagaacacatttttgtaagtagattaaaccttgtcattctgttttgttcttcaggctacttagccaagcttctctgcccagatgatgtagagataaataaaccagataaatttaaacccaccctaactcaaattggcatatattttgaaataacaaagttagaatcagttttgttggatttactggaaagtctgatgtgatcatagccatttgttctggttccaaccagaagaacattaaaaattagaaaataatgtgtctcctgcttatttcccctggggtaaaagtcagaaaagatcttttcatgatcccttggagatggcgcttgccagaggcagggaggagtgtaggcatcagtggagatggtgagcccccaggggcagccactcaccaagccatggttacctgtgcctgttttgtgcctagcacatgataaagggcactcacatcacagagcctgttctctaaattcaaggataagattggaataggcaagggaggaacagaggagaaataaaatgcaaagggaaacatcagaaatgaatcattagcttttaagattccaagag

SEQ ID NO: 15193 - DNA, 4992 bp, Homo sapiens
aggcctgcccgccctgatggtcatcggcactgggagtgccaacagctacggcctctacaccatccgtgatagggagaaccgcacctctctggagctgtgagtggcggctgtgggagcaggggtgatgccagctccccggctacacatattggggctggagagaggtggggagaggagggatttctaggaaaatctagaccaaatatgtcaagaccagaagaatcctcagatccagctagctcatggcacagagaagtaaactgaagcctagagagagagaggggaagtgaaatgagagagggggcctgagaaaggagagggagaactggaccaggaggcaggatgccttacttgagcctgggccaacacgagcccacatggcaccttgaggcaaagtaaagaaggtcaccccgtccgcatgcggggtgcgcagcctggagagtggagggtgtgttggatttcagcccccacctgctgcccagccaggtgtccttgttcaggccaccacctgcccagtgattcacagtagccctgggtctagtctgggctctgccctgcctgctatgtgtgtgatcttggcaggcccgatctctcccagggcctcagtctcctcatctgcaccatgggggaactgatcaacatgctctttgaggccctttgcccctgcagtgcagagggcagtggagctgagttcagtttctagactcacaccttgggatccatggggcacccaccactgggcccatggctctgtgctaagaggagctggtgaggccttggacctgtccccaggcctcaaaagcaggggccccaggagctggaggggtcacaaaggtgcaggcagtgggccaggtggggactgcagcggactggcagtcacaagcccatctaattagcggtcagttactatccttcaggagggcatccacagagctgccaggtgtatgattttataggagaagcagaaatctaggtgtttataccaaagcttctgattttaaaggcggccactaattccgtttttttcacaatgtaatatggggcaaatgaaacatgtctttgaggtcactttggcattaaagagacaccagactggagccaggtgacggcccctcccacagcgggagagccagggattgatgggtggaaatgggagaggcaccttcacagacagaaaagctcagccaggggacttcctgggtttgctggccagaggtaccactcccagtcccaccacagctgccccctcctccagatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaaggtgaggcccctgcaccagggaggtgatgggctgtgttgtctgtcccaggaggtattgggaggtggggaagagggtggtttgcaagacacaggactctgttcaggctagctgaagtcaaggatgttgatttcaaatactcagagcaaggatccagggcagcaaagtttggctgctgtattagtccgtttgtgttactagaatacaaaggaatactcgagactgggtaatttataaagaaaatggggttaattggctcatggttctgcaggctttagacaaagcacaacaccagtatctgctcctggtgaggcctcaggaagcttccaatcatggtggaagataaaggggagccaggcgtatcacatggcgagagtgggagcaagggagtggggaggcaccatgccgttttaaacagcgagatctcgcatgaactccaagtgagcactcactcatcaccaaggggatagtgctaagccatgcatgaggatccgctccaaggatccaatctcctcccctcaggccccacctccaacattgggaatcacatttggacatgagatttggaagcaacaaacatcccagacatatcagctgccttcatgggagctgctaccagaatcagaaaaagccacccaaaccaaagcagatacgttctctatctttttcctggagctatggagtctctcacctagtgtctgtggaaactccttcattctctctccacttaccctttactacccatggccccaaattgttacccaacatggctgccgtaaccctacctgaccttgcaagttgggtgtccatcgtccatctctggtccaatcagctgcgaccagaagggcagaatcatgtgatatgatgtccacatgacatggatgggatctccagggatctatggaggtaggaaggaaatgcttgctgtatttgttactggcccccgcagggcccttcctctgagatcccagcaaaggggtaagagcagtccatgtgctatggtttatatgtgttctctttgctccttacatccacagcccagagaggcatcacagtctgactgtgagagaaacagccaagacaggagtgacgagactcaacctgttcagggaagtcactagaaacccaggcgtcctagatgcagcgggtataagcccccaagaccaggactggctcccagcgccccatgagagatgtgtggcttagtggctagggccaggcagccctgggtccaaatcctagccccatccctgacccagcaagtcactcagctccttccgtcctcattcatcgcgaaattgggataatcccgtacttatctcaccagcttttttttttttttaattgagatggagtcttgctctgtcacccaggctggagtgcagtggcacgatctcagctcactgcgacctccacctcctgggttcaagtaattcttctggtttcagcctcctgagtagctggaactacaggcacatgccaccatgcccagctaatttttgaatttttagtagaaatggggtttcaccatactggtcaggctggtctcaaactcctgacctcagatgatctacctgcctcagcctccgaaagtgctgggattacaggcgtgagccactgtgcctggcctgccagatttcacaatgaacaatgacaatgcatatgtgggaactactaggtcttcaatatgtgggaactatattaataatcatagaaattatgactgtaaggccatctgaggctgtctccaggtggagaatcatgagtccatgcctggagaatcccaggggttgatggttggggagaaatgaactttgaaactatagctgacatcgttattctttcagaggttaccttaatatgtaagcctgcacacttcactctactaagtttccactgggtctgagttattctgtatttctctcttcctctccaatacaacagagcccttggtatacttgaattgcccattgaactcttctcaatatttgtcttgcatatagaggtttagttacagatttccttgaaacatagagtttttctaagtcatgttctgtacttactataatttctttcaccccacactttcccttttcctcttgctggagtgcctcccataataatcctttatagagggagtgatggttgttttgtatgtctgaaaattcctctattttgctctttcttttctgtaataggcataggtagatattttatttgaaggtctctgtttttcatttccaagatttcgatttggttcttttttatttcatttttgaaatggttgtgaaatggttgcatttttgcctttcccagcagttcttgagtggttacggtgggtctcctccctctcagcagccaccagcccaggctgccccactctctgcccacccctttccaggctcaccgaggcctctccttcctaacaggtgtcttcatctgctgctggttcaccatcctttacctcccaagtcagagcaccacagtctcctcctctactgcaagattggaccaggcccactccgcatctcaagaataggaaggcacggccctgcaatatggactcagctctggctctctgtgtgaccttgggcagctccgtgcctctctctgtactccctcagtttccttctctgtacaatgtggctggggagggagaggatgggaccaggttggaccacgtggcatcagaggtcccatccagatccaactataggtccaagagtccacgtaagcaggtttgcaaggctctaaagttcctatagtcctgagaccccctgccagcaaagagtgacagtcacctccatgccctgccctcattgcaaagccctcactcaccttctggtctcagcaagggaggagagtctgttgctggcatagccctggaaggagcccccagcctctcccctcctcctccttgtcactggcctcccacaactccccttctggctgcctgtaaccttgaggggcattcaggaggccagcgttccctcaggcactgggggtttgttttggggggtgggagttgatcctcccacccagtctgcccctggtctctgcccatccaatcagagcccaccctcctggaagagacccccgtgttcagagtgctggcagccctgcacgtgtccagggacactgcatttcaaagaaccactgagtgggtgagctaccttgggcaaaccccccactcctgactctgactgccacgtgggtggcccgacctctgacctgctgtcatcgtagaggtagaaagcaaacaatctggggctcagcacacctgggggtgctcccactcattcagtgtgtggggcccctgagcagaggctgggcattgccactaggacctgagctcctagagaacaaggacctgggtggcctcgcttactgttccagcccaggccaagcacagggtctggctcgtggcaaaccttgaataaatatttgttggctgaa

SEQ ID NO: 15194 - DNA, 3861 bp, Homo sapiens
agggaccactggagactggtcttctgagggctgctccacggaggtcagacctgaggggaccgtgtgctgctgtgaccacctgacctttttcgccctgctcctggtaacagccccctccactctgatcccagccatcccaggggcttccagctcctgccctggggagggggctgcctggtggtctttgggtatatgggcctggcctccaactgacgtggtcccggttctggggtcacccacagagacccaccttggaccagtccacggtgcatatcctcacacgcatctcccaggcgggctgtggggtctccatgatcttcctggccttcaccattattctttatgcctttctgaggtgagtgatccccacctccccaccatgtctccctcccgccctcaagggaggcagcagggcagggtgggaagcattcaggttgtgcagcctctgaccgttgtcccctccacacgttagtgtcctcatcccaaaatggggttgggggttgaaatgtgtcagagctatttcaggagcaagtggcagaaactcaactcaaattggcttaaacataatagggaatgtgtggttcacgtaactgagaatagcaaatagcaaatagggttcatgtaattgaaaaacccaaggtgcatggacttctggcagggttcgatccagggggtcaaaagaggtccccagaacttggtctccctctacctctcacagctttgctcgccccttgacagtcacatcgggcagctttaccaccctcaggggccctggctgcctcaggattgcatcatagctccttagctgcttaggcagaaataaaagagatctcctctttccaagtattctaagatgaatcccaggattgagaaggattttattttgagataaaacagaaagatgcaaaaatagtgcagagtcctgtggttcgttctcccagattccccctgtggatacatcatagacaactgtagttcaatatcaaaaccagcagctggtggtacagtactgttgactagaatacagactttgctcagttttcaccattttttatgtacattcatgtgtgtgtctgtgtgtgtgtctgtgtgtgtgtgtgtgtgtgtgtgtgtgcgcgcgtgcgtgcgcgcaggacatatcatttgattggcccagtccaaaatgaaaataaagaaggctgggcgtagtagctcatgcctgtaatcccagcactttgggaggccgaggcaggtagatcacctgaggtcaggagttcgagaccagtctggccaacatggtgaaagcccatctctactaaaaatacaaaacaaaagttagctgggcgtggtggtgcgcgcctgtaatcccagctactcaggaggttgaggcaggagaatcgcttgaaccaaggaggcggaggttgcagtgagccgagatcacaccattgcactccagcctggacaacaagtgcaaaactccgtctcaaaaaaaaaaaaaaaaaaaagagagagagagagagaaagaaaatatatggccccttattcaaaaaattttaagaatgtcaagatggcgacagtagaacattaagtccttctgcgtatggggtcctacagaggtcacatgctcatgaaactggccctgtgtgagcatgtgtgtgcatgtctgtgtatatcagcctatgcagttttatcccgtgtatacaccagagttgagtcttactggtctaacttggaccatgtgcccatgcctgtctgggtcactgtggtcaagagctggaatacacagattggccggccaggccatgtgtctgctcttgggtttgagctaacaaagaacccctggcccctgacttatgagagtggggacgggcgttccttagggaaacctggggctgtgtccagaagaggtgggagtgagtgcaggacaggcagaaacagcagagagcactgcagcctgggcccaggccatggctgagggacccacaggatctgccagcttgaaggagcctaggggagctgccagtgctccagcttgtcctgtcccctgcctcctgggggtccctgggggtggcctaaagcagcccttgggtctcctgcccccgcatccagggccgtccctccgccctctccacgtgcctctgtgtcagcatttggccctaggctgcagccccaactaggcccacccaatccatcacagaccaacccatgagtgtaaatggtgcccctcacccccaccctccaagccctggcctaggacatggtccccatccccaacaagccgagtgtgacttgccagctggccgcattgctggaccctgtgagcggggcttggagcgccaggagaaattaccaccagctccccagggtggggcctggcatctcaggtgaggtggacatgatcccagatgctcctccaggaagcccccggctcccctccctcggctgagagcccttttggatctggtttgctaagaattcagagtgggggctccagagagagggaggtgagcctggtgagtcactggacagggagtctggagcccagggttggagcccctgccctgctctgtgaccccataaggctcccgtccctctctaagcctcactctcctactgcattttcggcttcatgcatccacccatctgtccatccacttcaccaatggatccctggtcccaccactgttaggcctgaagttcacagcatgggaaagacccgaggagagagaggatggggagttacactatgctgctgggaaatgtccagttcagctcaggctaaggggcattcagagatggcctccccagaaggaaacctccaaggggcatttgaaaggcagaagaagaggagtcaggcaaagaaggtgggaggagctggggagcagggaaaggcattgagaacagtgggaagagctgacctctgcgaaatgagatcagcctcaccttggtatagtttgggtcattccaggtgttttttttcttctcttcccaaggctgcctaatctctagccagtgtctggcttttgactgataggtgtgttgctcagttactttgggcccgtgtacgtttgtgtgtcacctccatcccataattttaagtacatgcatgatatgcagcccatatgcatgaaccttaagtagctaattatcatacagggttatgtgaaagaaactttttctctctaatgtaaatgcccatctctgaagagctgccccttactggtttggtccggatcttgccggccacggggtcccttttttatgtcacttttgtcttgcctgctgaacctctgcttttcatctcacttcttgctcacccgtcccattcaccgtgcttctattctctgcttttacttattctgccctttatccaacttttaattccctttgctattctcctgcctcattttctggcctcattttccctattatcctgcctcacattgatcaagggatgaggctggcaggatccggaacccacagggccccgtgggccatgagaggctcctggacttgaacctcaggacactcccactctggctgccggcagggatggaagctggatgagcaggcaggagctggcagtgggggtggagagccataggctattggggtggacaggcttgggtgcctcatgggagctccccatgggagctgtggccccttggggcctcttatttctcaccccaggctttcccgggagaggttcaagtcagaagatgccccaaagatccacgtggccctgggtggcagcctgttcctcctgaatctggccttcttggtcaatgtggggagtggctcaaaggggtctgatgctgcctgctgggcccggggggctgtcttccactacttcctgctctgtgccttcacctggatgggcct

SEQ ID NO: 15195 - DNA, 148 bp, Homo sapiens
tgcacctgtagtcccagctactcaggaggctgaggcaggagaattgcttgaacctgggaggtggaggttgcagtgagctgagattgtgccactgtactccagcctgggcaacagagcgagactccatctcaaaaaaaaaaaaaaaaaa

SEQ ID NO: 15196 - DNA, 2673 bp, Homo sapiens
cggcggggccgtgtctggtctgcaaggcgcgcgggctcgtggggggttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagaggtagaggggctgcggcgggccttcgccttttcagctggctctccacgctggggagaggcgcccagctaggggcgacgggggagggaggggaccgggaagcgggcacccgagcccagcgagccagcctctctctcccgggcgccctccctccgcgcgcggggcccggctgccaggctggcgaggactggggcgacagccatggacctgttacaaaggcgaccgcaggcggagggagggagcggcgggccagggcccctggagccgacggatgggattggagaatgcccagggctgtatccctggacagaaaggggcttctgcatcccccgggaaaaacagccccacggagatccttcttagacctgggctccttcacgcttcccccatcccattcatcatctcgtagacagcagactctctaagaggaaaggttgtattgcaatacagtaatggggtctttaggcctgggtgcaaaggtagaagaagatgatggtgatagtgatggtggtgatggtggtagtgatgatggtgatggtggtggtgatgatggctgtagtgctatatttctgtgctccttccggacccagccattgaaaactctctctccctaaactccctaacatccaatcttccctcaccaatcctggtcctaaaacccctgcttctaatgccttgtaagtgcttggtttctcttggcactggagcaagggagagctgggccctgtctaggggtgtgagatggggacagagcatgggcagggacaaagatggcctctcactgctggtcatagagttgaagtccccctggcaggaggccaggaagggagtggaaggggattctgcaggctccaggacctcctgctttcaaacaggcaggaccacaggtgtgagaggatggggagggagggggaaggggccttgccattgttgcctccctgcctgaaggtcccagggcaagcctcaaacgctggtccttcccagctctgcagctcaacaggtaatctgagacacacctgctaagcccctcgttattgacctcgtgttttgtagggtcacttgactccaacagccatacggttggtaattctaagcctctgagcccctggacctggcaggatccctcatttttccctttccttcctgctttctaggcccccaccacccacccctgtcccccctcccctcaagacacacacagacaaaacactccaaccctgcgtcaattcccccaccatccacctctgtcaccctcccctcaagacacacacagacaaaacactccaaccctgcttagattcagaaattctcacattagagctgagatctgatcagtaatttcctaatgctgatccaaggagggtggtttgcctgttgtgcacatagattggtgccttcttccataagctcatgcattcagcaagtatttattttttgcaaacttactcttcctctttattgctattctccactcaccccatcccacccccaccacacccttcccatagcaggtttatctctgaggcagtggcaggtcacgaaggggttaaagtctaactctggcacagagatggcaggcctgacatgtgtcatggcctcagctgctgttgtctccctgctaattctctttggatgggtctaaaggtacccccaaccccatcccagctccctaggctctctgccgatagccccaggcagatgagactcagattccagctggcaagatccccagcagtggggacaaccacccaagtgccgtgtgtgtgtgtgtgtgtgtgtgtgtgtatgcgtgctggcagtgggggtggggtgatgaagctgaaacctagcagctgggcagctccctctccccgtaaacaaggacatgtgactctcccacctcgtttcgtggcagagccaaagagctgagcaaaaggagctgctgcagcttgaagaaaaagccacccctgaaggctcctgccagagccaggcttaccttctctccctcgagaatcttctcccgaaggaccagcccagggaagggaagcagctgctctggactcactcaagtgtgtctcacaccccttcctcttccagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccag

SEQ ID NO: 15197 - DNA, 7733 bp, Homo sapiens
cggcggggccgtgtctggtctgcaaggcgcgcgggctcgtggggggttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagaggtagaggggctgcggcgggccttcgccttttcagctggctctccacgctggggagaggcgcccagctaggggcgacgggggagggaggggaccgggaagcgggcacccgagcccagcgagccagcctctctctcccgggcgccctccctccgcgcgcggggcccggctgccaggctggcgaggactggggcgacagccatggacctgttacaaaggcgaccgcaggcggagggagggagcggcgggccagggcccctggagccgacggatgggattggagaatgcccagggctgtatccctggacagaaaggggcttctgcatcccccgggaaaaacagccccacggagatccttcttagacctgggctccttcacgcttcccccatcccattcatcatctcgtagacagcagactctctaagaggaaaggttgtattgcaatacagtaatggggtctttaggcctgggtgcaaaggtagaagaagatgatggtgatagtgatggtggtgatggtggtagtgatgatggtgatggtggtggtgatgatggctgtagtgctatatttctgtgctccttccggacccagccattgaaaactctctctccctaaactccctaacatccaatcttccctcaccaatcctggtcctaaaacccctgcttctaatgccttgtaagtgcttggtttctcttggcactggagcaagggagagctgggccctgtctaggggtgtgagatggggacagagcatgggcagggacaaagatggcctctcactgctggtcatagagttgaagtccccctggcaggaggccaggaagggagtggaaggggattctgcaggctccaggacctcctgctttcaaacaggcaggaccacaggtgtgagaggatggggagggagggggaaggggccttgccattgttgcctccctgcctgaaggtcccagggcaagcctcaaacgctggtccttcccagctctgcagctcaacaggtaatctgagacacacctgctaagcccctcgttattgacctcgtgttttgtagggtcacttgactccaacagccatacggttggtaattctaagcctctgagcccctggacctggcaggatccctcatttttccctttccttcctgctttctaggcccccaccacccacccctgtcccccctcccctcaagacacacacagacaaaacactccaaccctgcgtcaattcccccaccatccacctctgtcaccctcccctcaagacacacacagacaaaacactccaaccctgcttagattcagaaattctcacattagagctgagatctgatcagtaatttcctaatgctgatccaaggagggtggtttgcctgttgtgcacatagattggtgccttcttccataagctcatgcattcagcaagtatttattttttgcaaacttactcttcctctttattgctattctccactcaccccatcccacccccaccacacccttcccatagcaggtttatctctgaggcagtggcaggtcacgaaggggttaaagtctaactctggcacagagatggcaggcctgacatgtgtcatggcctcagctgctgttgtctccctgctaattctctttggatgggtctaaaggtacccccaaccccatcccagctccctaggctctctgccgatagccccaggcagatgagactcagattccagctggcaagatccccagcagtggggacaaccacccaagtgccgtgtgtgtgtgtgtgtgtgtgtgtgtgtatgcgtgctggcagtgggggtggggtgatgaagctgaaacctagcagctgggcagctccctctccccgtaaacaaggacatgtgactctcccacctcgtttcgtggcagagccaaagagctgagcaaaaggagctgctgcagcttgaagaaaaagccacccctgaaggctcctgccagagccaggcttaccttctctccctcgagaatcttctcccgaaggaccagcccagggaagggaagcagctgctctggactcactcaagtgtgtctcacaccccttcctcttccagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccagtatgtatcgggcagactgggcccacggtagagcgtgtgtgtgtttgtgtgtgtaagaaaggagaagggtggcagacaggtatgcagtggtgtcattggttcctggttgaagattgaggggatagggcacatgggccaagagtagaggctgcaggtttgggagagtttggccaggattattgaaatgcccaactctggccagtcacagtgtctcttgcctgtgatcccagcagtttgaaaggctgaggcaggagtatctagagtacaggagttctagaccagcctgagcaacaaaaccagaccccatctctacttattattttaaaataaaataaataaaataaaaatacccaagtctggacagaaagactctgttccagtaataatatcattcatgtatcacatatttattattacatgccagtgctacataccaggcacaatagatgacttctctgaccttccatctattgtgcaatgtctctgggaaaaggcagccactggaagccaggagcagtaggtaggaagctgcagtggtttctcttgagaccaagcaaagcggcagtgcctacagagattctgcaatttgaaggctatggagagaaaaacatcaaaggaagagccatccccacttctctccctcaaagttatacaaggatttcttttgcttctttggtttgttttggttttggtttctttcttttatttttttttggagacagtatcactctgtcacccaggctggagtgcagtggcgcgatcttggttctctgcaacctccacctcccgggttcaagcgattctcctgcctcagcctccagagtagctgggactacaggcacacaccgccttgcccggctaattatttttttgtattttagtagagacggggtttcaccgtgttgcccaggctggtcttgagctcctgagctcaggcagtccacctgtctcggcctctcaaagtgctaggattataggtgtgagccaccgtgcccagcattgttgttgtttttgagacagggtctcactgttgcccaggctggagtgcagtagcccaatctcagctcacagcaaactccgcctcccgggttcaagcaattctcctgcctctgcctcccaagtagctgggcttacagacgcccatcaccacacacagctgatttttgtatttttagtagagacggcgtctagccatgttggccaggctgattttgaactcctggcctcaagtgatccacctgcttcagcctcccaaagtgctgggattacaagcatgagccaccgtgcctggcctacaaggatttttttcacacacattatctctcttaatcttcacaacagccctgtgagataggtatcactctccctgggttacagatgaggagactgaagctcagagaagttgtgcctggccaaggtcacacgggttgtaagtagcagagcccgggcttggaggctcaagttcagtgctctttctgcttaaggagtttgcactggacagggcaactcagtttgccctgagatatgactgtggtgcccaggggtgtctgccaccaagctgaggggtctgggccggatgaacacctgaaggtgacgtcataaaacagggtaaatgtggccgggcatggtggctcacatctgtaatcccagcactttgggatacttaggcggatggatcacgaggtcaggagttcaagaccagcctggccaagatagtgaaaccccgtctctactaaaaatacaaatattagcctggcatggtggtgggcacctgtaatcccagctactcgggaggctgaggcagagaattgcttgaacccgggaggcagaggtggcagtgagccgagatcgcgccactgcactctagcactccagcctaggtgacagagcaagacaccatctcaaaaaaaaaaacaaacaacaacaacaacaacaaaaaaaaacacagtcacagtaaatgtgagccatggaatatctggcaaaaacacaagacggttctgggtgtcaacaagagtagagacataggggagttaggtgtggaagtggatgtcagaaccatactatctcagagtgagcaggaccgatgaaatgagcagaacaatctgcctgacattcatttcccctctgcagcatccatggctacatggccatctcctctttctgcctgaataccccagggacaggaaaaccactctctctcgaggttctccaccctttcctcagctagactccaccattagaatgtacttccttgtatgaaattgaaatcagctggccaggcacagtggctcacgcctataatcccagcactttgggaggcctagataggtggatcacaaggtcaggagttcgagaccagcttggccaacacgatgaaatcccatctctactaaaaatacaaaaattagccgggcatggtggcaggcacctgtaatcccagctactcaggaggctgaggcaggagattcgtttgaacctgggaggcagaggtggcagtgagcactctggcctaggaaacagagcgagactccatctcaaaaaaaaatcaacaataggattcaggaagttaacagggtgtagacaagggagtcttccccaacaacctggctttcccacccttcctctaacctctactcaatgcagggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggaggtaggaggggaatgctgggagcaggaaagaacagggtgcctggaatttggggaagtccaagggtctgagagtggagtgagattttagtgacatgacaaaatgctcaggatcttgttaagaaagaaaaaaatattatctcaaccatttttttaaagcaatacagaaaaagacaagaaggaaattatcaaaaatgttaagagtggcaagttacacctgggtggcaagattatatgtgatcgactttttcttttttgtttttttgagatggagtctttctctgtcacccaggctggagtgcagtgacgtgatctcagctcactgtaacctccgcctcccaggttcaagcgattctcctgcctcagcctcccaagtagctgagattacaggtgtccgccaccacatccagctaatttttgtatttttaatagagacatggtttcaccatgttggccaggctggtcctgaactcctgacctcaggtgatccacccgcctcggcctcccaaagtgctggaattacaggcatgagccactgcacccagccagcaggaggatttcttaagcccaggaattagaggttgtagtgagctatgattgtgccactgcactcagcctgagaggcagagcaagaccctgtctccatatacatatatatatattcaatggttgagaataacaagctagaatggtggagagattgaggaaggggccagtaatgacagtgttttcaatggactcattcacgctactctatgcaaagctggctcttacatcagtggtgagtctccacctttgacccctttcaggtttatggacactgagccactgcatgtccccttcctctcattctgtccaggcctctccccttttgccagagatctgcattcctaacatccactcatctgcacccattcctgtcttcatgcacctgtacttacctgtcttcctcttccctgtccatgtcaccctttttttttttttttttttttttttttgagatggggtttcacttttgttgcctgggtggagtgcaatgacacgatcttggctcactgcagcctcagcctcctgagtagctgagattacaggcatgggccaccacgcccagttgatttttgtatttttagtagagatggggtttcaccatgttggccaggctggtctcgaactcctgacctcaggcaatcttcccccttcggcctccaaaagtgctggaattaccgccgtgagccaccatgcccggccccatgtcaccctttccccagcctcctccaagctgccacaagcagtctcaaagctctctctgtgtctctcctctcagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggacggggagtgaggttgggcagtgtggtggatgggcacccaggaagggttgaccagggaaggaggcagctaggctgtagatggaagatggtcctgggattcgaacaccgctgggatctggccagggtgctccctgggattcacagtcccttcccctctttgtgcccaagtgtttccctctctccctcaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgaggataaataaagatcatgaaaaagaa
